(12) United States Patent
Schellenberger et al.

(10) Patent No.: US 10,172,953 B2
(45) Date of Patent: Jan. 8, 2019

(54) XTEN CONJUGATE COMPOSITIONS AND METHODS OF MAKING SAME

(71) Applicant: Amunix Operating Inc., Mountain View, CA (US)

(72) Inventors: Volker Schellenberger, Palo Alto, CA (US); Vladimir Podust, Castro Valley, CA (US); Chia-Wei Wang, Milpitas, CA (US); Bryant McLaughlin, Millbrae, CA (US); Bee-Cheng Sim, Mountain View, CA (US); Sheng Ding, Redwood City, CA (US); Chen Gu, Fremont, CA (US)

(73) Assignee: Amunix Operating Inc., Mountain View, CA (US)

( * ) Notice: Subject to any disclaimer, the term of this patent is extended or adjusted under 35 U.S.C. 154(b) by 183 days.

(21) Appl. No.: 14/381,199

(22) PCT Filed: Feb. 27, 2013

(86) PCT No.: PCT/US2013/028116
§ 371 (c)(1),
(2) Date: Aug. 26, 2014

(87) PCT Pub. No.: WO2013/130683
PCT Pub. Date: Sep. 6, 2013

(65) Prior Publication Data
US 2015/0037359 A1 Feb. 5, 2015

Related U.S. Application Data

(60) Provisional application No. 61/709,942, filed on Oct. 4, 2012, provisional application No. 61/690,187, filed (Continued)

(51) Int. Cl.
*A61K 47/00* (2006.01)
*A61K 47/48* (2006.01)
(Continued)

(52) U.S. Cl.
CPC ........ *A61K 47/48246* (2013.01); *A61K 38/24* (2013.01); *A61K 47/64* (2017.08);
(Continued)

(58) Field of Classification Search
CPC .. A61K 38/24; A61K 47/48246; A61K 47/64; A61K 49/0032; A61K 49/0052;
(Continued)

(56) References Cited

U.S. PATENT DOCUMENTS 5,270,176 A 12/1993 Dorschug et al.
5,599,907 A 2/1997 Anderson et al.
(Continued)

FOREIGN PATENT DOCUMENTS

WO   WO 97/33552 A1   9/1997
WO   WO 99/49901 A1   10/1999
(Continued)

OTHER PUBLICATIONS

Terpe, Overview of tag protein fusions: from molecular and biochemical fundamentals to commercial systems, Appl. Microbiol. Biotechnol., vol. 60:523-533 (2003).*
(Continued)

*Primary Examiner* — Randall L Beane
(74) *Attorney, Agent, or Firm* — Wilson Sonsini Goodrich & Rosati

(57) ABSTRACT

The present invention relates to extended recombinant polypeptide (XTEN) compositions, conjugate compositions comprising XTEN and XTEN linked to cross-linkers useful for conjugation to pharmacologically active payloads, methods of making highly purified XTEN, methods of making XTEN-linker and XTEN-payload conjugates, and methods of using the XTEN-cross-linker and XTEN-payload compositions.

24 Claims, 119 Drawing Sheets
Specification includes a Sequence Listing.

US 10,172,953 B2

Page 2

Related U.S. Application Data on Jun. 18, 2012, provisional application No. 61/634,312, filed on Feb. 27, 2012.

(51) Int. Cl.
- C07K 5/02 (2006.01)
- A61K 49/00 (2006.01)
- A61K 38/24 (2006.01)
- A61K 47/64 (2017.01)

(52) U.S. Cl.
CPC ...... A61K 49/0032 (2013.01); A61K 49/0052 (2013.01); A61K 49/0056 (2013.01); C07K 5/0205 (2013.01)

(58) Field of Classification Search
CPC . A61K 49/0056; A61K 38/00; A61K /; C07K 5/0205; C07K 2319/31; C07K 2319/00; C07K 2319/35
See application file for complete search history.

(56) References Cited

U.S. PATENT DOCUMENTS

| | | | |
|---|---|---|---|
| 7,442,778 B2 | 10/2008 | Gegg et al. | |
| 7,452,967 B2 | 11/2008 | Bertin | |
| 7,528,242 B2 | 5/2009 | Anderson et al. | |
| 7,709,605 B2 | 5/2010 | Knopf et al. | |
| 7,846,445 B2 * | 12/2010 | Schellenberger | C07K 14/001 424/178.1 |
| 8,129,348 B2 | 3/2012 | Besman et al. | |
| 8,178,495 B2 | 5/2012 | Chilkoti | |
| 9,371,369 B2 | 6/2016 | Schellenberger et al. | |
| 9,926,351 B2 | 3/2018 | Schellenberger et al. | |
| 9,938,331 B2 | 4/2018 | Schellenberger et al. | |
| 2003/0022349 A1 | 1/2003 | Ausubel et al. | |
| 2003/0049689 A1 | 3/2003 | Edwards et al. | |
| 2003/0181381 A1 | 9/2003 | Himmelspach et al. | |
| 2003/0190740 A1 | 10/2003 | Altman | |
| 2003/0228309 A1 * | 12/2003 | Salcedo | C07K 16/2878 424/144.1 |
| 2004/0043446 A1 | 3/2004 | DeFrees et al. | |
| 2004/0259780 A1 | 12/2004 | Glasebrook et al. | |
| 2005/0032081 A1 | 2/2005 | Ju et al. | |
| 2005/0042721 A1 | 2/2005 | Fang et al. | |
| 2005/0118136 A1 | 6/2005 | Leung et al. | |
| 2005/0123997 A1 | 6/2005 | Lollar | |
| 2005/0287153 A1 | 12/2005 | Dennis | |
| 2006/0026719 A1 | 2/2006 | Kieliszewski et al. | |
| 2006/0287220 A1 | 12/2006 | Li et al. | |
| 2006/0293232 A1 | 12/2006 | Levy et al. | |
| 2007/0048282 A1 | 3/2007 | Rosen et al. | |
| 2007/0161087 A1 | 7/2007 | Glaesner et al. | |
| 2007/0203058 A1 | 8/2007 | Lau et al. | |
| 2007/0244301 A1 | 10/2007 | Siekmann et al. | |
| 2008/0039341 A1 | 2/2008 | Schellenberger et al. | |
| 2008/0167238 A1 | 7/2008 | Rosen et al. | |
| 2008/0176288 A1 | 7/2008 | Leung et al. | |
| 2008/0286808 A1 | 11/2008 | Schellenberger et al. | |
| 2008/0312157 A1 | 12/2008 | Levy et al. | |
| 2009/0060862 A1 | 3/2009 | Chang et al. | |
| 2009/0092582 A1 | 4/2009 | Bogin et al. | |
| 2009/0169553 A1 | 7/2009 | Day | |
| 2009/0280056 A1 | 11/2009 | Dennis et al. | |
| 2010/0189682 A1 | 7/2010 | Schellenberger et al. | |
| 2010/0239554 A1 * | 9/2010 | Schellenberger | C07K 14/001 424/94.3 |
| 2010/0292130 A1 | 11/2010 | Skerra et al. | |
| 2011/0142859 A1 | 6/2011 | Ebens et al. | |
| 2011/0151433 A1 | 6/2011 | Schellenberger et al. | |
| 2011/0288005 A1 | 11/2011 | Silverman et al. | |
| 2013/0137763 A1 | 5/2013 | van Delft et al. | |
| 2016/0280753 A1 | 9/2016 | Schellenberger et al. | |
| 2017/0037088 A1 | 2/2017 | Schellenberger et al. | |

FOREIGN PATENT DOCUMENTS

| | | | |
|---|---|---|---|
| WO | WO-02077036 A2 | 10/2002 | |
| WO | WO 2005/025499 A2 | 3/2005 | |
| WO | WO 2005/025499 A3 | 5/2005 | |
| WO | WO 2006/081249 A2 | 8/2006 | |
| WO | WO 2006/081249 A3 | 2/2007 | |
| WO | WO-2007073486 A2 | 6/2007 | |
| WO | WO 2007/103455 A2 | 9/2007 | |
| WO | WO-2007103515 A2 | 9/2007 | |
| WO | WO 2007/103455 A3 | 11/2007 | |
| WO | WO 2008/049931 A1 | 5/2008 | |
| WO | WO 2008/155134 A1 | 12/2008 | |
| WO | WO-2009023270 A2 | 2/2009 | |
| WO | WO 2010/091122 A1 | 8/2010 | |
| WO | WO 2010/144502 A2 | 12/2010 | |
| WO | WO 2010/144508 A1 | 12/2010 | |
| WO | WO 2011/028228 A1 | 3/2011 | |
| WO | WO 2011/028229 A1 | 3/2011 | |
| WO | WO 2011/084808 A2 | 7/2011 | |
| WO | WO 2011/123813 A2 | 10/2011 | |
| WO | WO 2011123813 A2 * | 10/2011 | ............. C07K 16/28 |
| WO | WO-2011123830 A2 | 10/2011 | |
| WO | WO-2011144756 A1 | 11/2011 | |
| WO | WO-2013130684 A1 | 9/2013 | |

OTHER PUBLICATIONS

Valjakka et al., Unreliability of the Chou-Fasman parameters in predicting Protein Secondary Structure, Protein Engineering, vol. 11(5):345-348 (1998).*

Gamier et al., Methods Enzymol. (1996), 266:540-553.*

Schellenberger et al. "Online Supplementary material: A recombinant polypeptide extends the in vivo half-life of peptides and proteins in a tunable manner", Nature biotechnology, vol. 27, No. 12, Nov. 15, 2009 (Nov. 15, 2009), pp. 1186-1190, XP055190665, ISSN: 1087-0156, DOI: 10.1038/nb.1588.

Cleland, et al. A Monthly Dosed GLP-1 Analog for Treatment of Type 2 Diabetes Mellitus. Diabetes, 2010; 59(1):A104. 70th Annual Meeting of the American Diabetes Association, Orland, FL, USA 2010.

Cleland, et al. An extended half-life exenatide construct for weekly administration in the treatment of diabetes mellitus. In Diabetes, vol. 58, pp. A511-A512. 1701 N Beauregard St, Alexandria, VA 22311-1717 USA: Amer Diabetes Assoc, 2009. Abstract only.

Altschul et al. Basic Local Alignment Search Tool. J. Mol. Biol. 1990; 215:403-410.

Alvarez, et al. Improving Protein Pharmacokinetics by Genetic Fusion to Simple Amino Acid Sequences. J Biol Chem. 2004; 279: 3375-81.

Arndt, et al. Factors influencing the dimer to monomer transition of an antibody single-chain Fv fragment. Biochemistry. 1998; 37(37):12918-26.

Ausubel, et al. eds. Current Protocols in Molecular Biology. Wiley. 1987.

Bailon, et al. Rational design of a potent, long-lasting form of interferon: a 40 kDa branched polyethylene glycol-conjugated interferon alpha-2a for the treatment of hepatitis C. Bioconjug Chem. Mar.-Apr. 2001;12(2):195-202.

Bengtsson, et al. The amino-terminal part of PRELP binds to heparin and heparan sulfate. J Biol Chem. Dec. 29, 2000;275(52):40695-702.

Buscaglia, et al. Tandem amino acid repeats from Trypanosoma cruzi shed antigens increase the half-life of proteins in blood. Blood. Mar. 15, 1999;93(6):2025-32.

Chou, et al. Prediction of Protein Conformation. Biochemistry. 1974; 13: 222-245.

Collen, et al. Polyethylene Glycol—Derivatized Cysteine-Substitution Variants of Recombinant Staphylokinase for Single-Bolus Treatment of Acute Myocardial Infarction. Circulation. 2000; 102: 1766-72.

D'Aquino, et al. The magnitude of the backbone conformational entropy change in protein folding. Proteins. 1996; 25: 143-56.

(56) References Cited

OTHER PUBLICATIONS

Deckert, et al. Pharmacokinetics and microdistribution of polyethylene glycol-modified humanized A33 antibody targeting colon cancer xenografts. Int J Cancer. 2000; 87: 382-90.
Dhalluin, et al. Structural and biophysical characterization of the 40 kDa PEG-interferon-alpha2a and its individual positional isomers. Bioconjug Chem. 2005; 16: 504-17.
Ellis, et al. Valid and invalid implementations of GOR secondary structure predictions. Comput Appl Biosci. Jun. 1994;10(3):341-8.
Geething, et al. Geg-XTEN: an improved glucagon capable of preventing hypoglycemia without increasing baseline blood glucose. PLoS One. Apr. 14, 2010;5(4):e10175. doi: 10.1371/journal.pone.0010175.
Gustafsson, et al. Codon bias and heterologous protein expression. Trends Biotechnol. 2004; 22: 346-53.
Hopp, et al. Prediction of protein antigenic determinants from amino acid sequences. Proc Natl Acad Sci U S A 1981; 78, 3824-3828, #3232.
International search report and written opinion dated Jun. 17, 2013 for PCT Application No. US13/28117.
International search report and written opinion dated Dec. 20, 2010 for PCT Application No. US10/02147.
International search report dated Jul. 12, 2011 for PCT Application No. US10/61590.
International search report dated Aug. 28, 2013 for PCT Application No. US2013/028116.
International search report dated Dec. 26, 2007 for PCT Application No. US2007/05952.
International search report dated Mar. 16, 2009 for PCT Application No. US2008/09787.
International search report dated Apr. 20, 2010 for PCT Application No. US10/23106.
Kochendoerfer. Chemical and biological properties of polymer-modified proteins. Expert Opin Biol Ther. 2003; 3: 1253-61.
Kohn, et al. Random-coil behavior and the dimensions of chemically unfolded proteins. Proc Natl Acad Sci U S A. Aug. 24, 2004;101(34):12491-6.
Kornblatt, et al. Cross-linking of cytochrome oxidase subunits with difluorodinitrobenzene. Can J. Biochem. 1980; 58: 219-224.
Kubetzko, et al. Protein PEGylation decreases observed target association rates via a dual blocking mechanism. Mol Pharmacol. 2005; 68: 1439-54.
Kyngas, et al. Unreliability of the Chou-Fasman parameters in predicting protein secondary structure. Protein Eng. May 1998;11(5):345-8.
Law, et al. Peptide-based biomaterials for protease-enhanced drug delivery. Biomacromolecules. Apr. 2006;7(4):1261-5.
Levitt. A simplified representation of protein conformations for rapid simulation of protein folding. J Mol Biol 1976; 104, 59-107.
Mitraki, et al. Protein Folding Intermediates and Inclusion Body Formation. Bio/Technology. 1989; 7:690-697.
Pepinsky, et al. Improved pharmacokinetic properties of a polyethylene glycol-modified form of interferon-beta-1a with preserved in vitro bioactivity. J Pharmacol Exp Ther. 2001; 297: 1059-66.
Rodriguez, et al. Does trypsin cut before proline? J Proteome Res. Jan. 2008;7(1):300-5. Epub Dec. 8, 2007.
Sambrook, et al. Molecular Cloning: A Laboratory Manual, 2nd Edition; Current Protocols in Molecular Biology. 1989.
Schlapschy, et al. Fusion of a recombinant antibody fragment with a homo-amino-acid polymer: effects on biophysical properties and prolonged plasma half-life. Protein Eng Des Sel. Jun. 2007;20(6):273-84. Epub Jun. 26, 2007.
Singh, et al. ProPred: Prediction of HLA-DR binding sites. Bioinformatics. 2001; 17:1236-1237.
Smith, et al. Single-step purification of polypeptides expressed in Escherichia coli as fusions with glutathione S-transferase. Gene. 1988; 67(1):31-40.
Stickler, et al. Human population-based identification of CD4(+) T-cell peptide epitope determinants. J Immunol Methods. 2003; 281: 95-108.
Stites, et al. Empirical evaluation of the influence of side chains on the conformational entropy of the polypeptide backbone. Proteins. 1995; 22: 132-140.
Sturniolo, et al. Generation of tissue-specific and promiscuous HLA ligand databases using DNA microarrays and virtual HLA class II matrices. Natural Biotechnol. 1999; 17: 555-561.
Uversky, et al. Why are "natively unfolded" proteins unstructured under physiologic conditions? Proteins. Nov. 15, 2000;41(3):415-27.
Venkatachalam, et al. Conformation of polypeptide chains. Annu Rev Biochem. 1969; 38: 45-82.
Walker, et al. Using protein-based motifs to stabilize peptides. J Pept Res. Nov. 2003;62(5):214-26.
Wright, et al. Intrinsically unstructured proteins: re-assessing the protein structure-function paradigm. J Mol Biol. Oct. 22, 1999;293(2):321-31.
Yankai, et al. Ten tandem repeats of beta-hCG 109-118 enhance immunogenicity and anti-tumor effects of beta-hCG C-terminal peptide carried by mycobacterial heat-shock protein HSP65. Biochem Biophys Res Commun. 2006; 345(4):1365-71.
Chou, et al. Conformational parameters for amino acids in helical, β-sheet, and random coil regions calculated from proteins. Biochemistry 13.2 (1974): 211-222.
Chou, et al. Empirical predictions of protein conformation. Annual Review of Biochemistry 47.1 (1978): 251-276.
Chou, et al. Prediction of the secondary structure of proteins from their amino acid sequence. Adv Enzymol Relat Areas Mol Biol. 1978;47:45-148.
Chou, et al. Prediction of the Secondary Structure of Proteins from Their Amino Acid Sequence. Advances in Enzymology vol. 47, John Wiley and Sons. Published 1978, p. 60.
Chou-Fasman values for random 200mer sequences composed of the amino acids GADSTEP; Reply to notice of opposition dated Apr. 8, 2016 for EP2402754.
Composition and properties of some URPs according to the invention; Reply to notice of opposition dated Apr. 8, 2016 for EP2402754.
Co-pending U.S. Appl. No. 15/154,223, filed May 13, 2016.
Corrected version of "Exhibit 1" (D23) without cut and paste error; Reply to notice of opposition dated Apr. 8, 2016 for EP2402754.
European search report and search opinion dated Jan. 11, 2016 for EP Application No. 13754824.4.
Kangueane, et al. T-Epitope Designer: A HLA-peptide binding prediction server. May 15, 2005, 1(1), 21-4.
Office action dated Apr. 29, 2013 for U.S. Appl. No. 12/939,129.
Office action dated Jun. 6, 2012 for U.S. Appl. No. 12/939,129.
Podust, et al. Extension of in vivo half-life of biologically active peptides via chemical conjugation to XTEN protein polymer. Protein Engineering Design and Selection, vol. 26, No. 11, Oct. 16, 2013, pp. 743-753.
Schellenberger, et al. A recombinant polypeptide extends the in vivo half-life of peptides and proteins in a tunable manner. Nature Biotechnology, Nature Publishing Group, US, vol. 27, No. 2, Nov. 15, 2009, pp. 1186-1190.
Tepitope values for random 200mer sequences composed of the amino acids GADSTEP; Reply to notice of opposition dated Apr. 8, 2016 for EP2402754.
Voet, et al. Biochemistry (3rd Ed.). John Wiley and Sons. Published 2004, p. 230.
Co-pending U.S. Appl. No. 15/887,313, filed Feb. 2, 2018.

\* cited by examiner

A
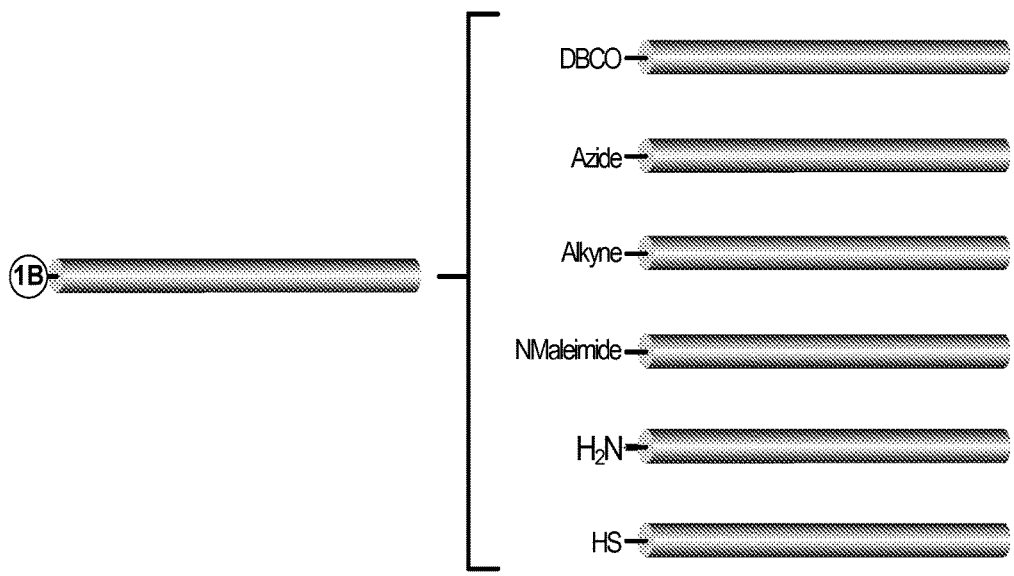
B
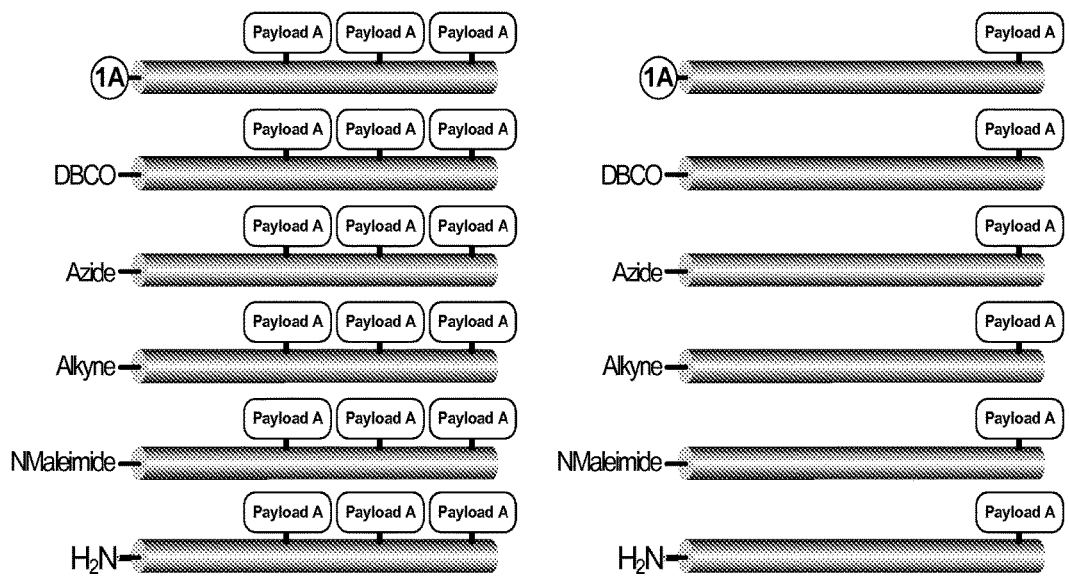
FIG. 17

A  Reactive Groups
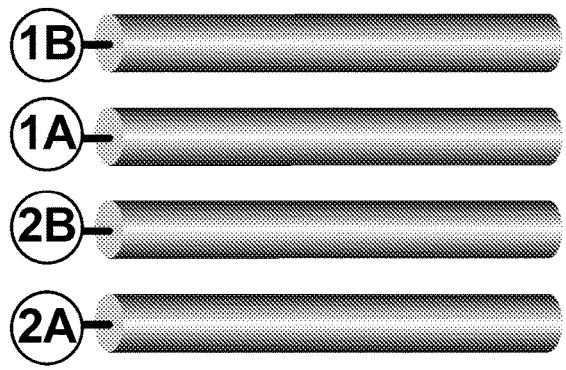
B  Cross-linkers
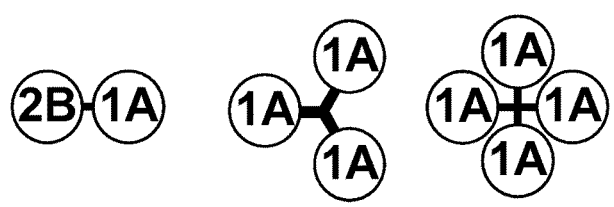
C  Conjugation Links
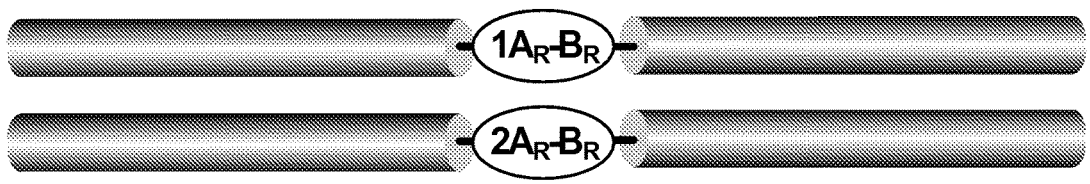
FIG. 19

A
B
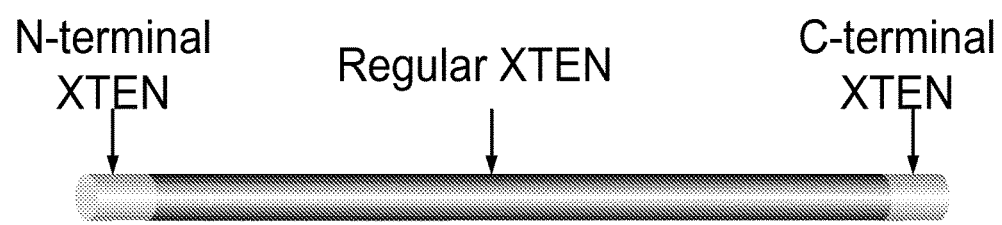
C
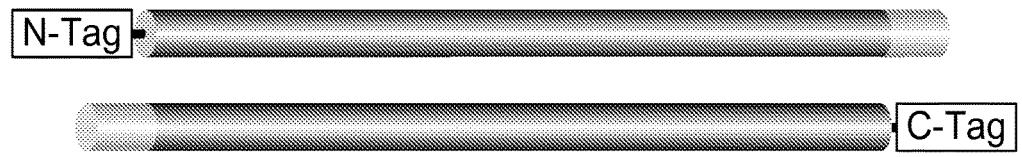
FIG. 41

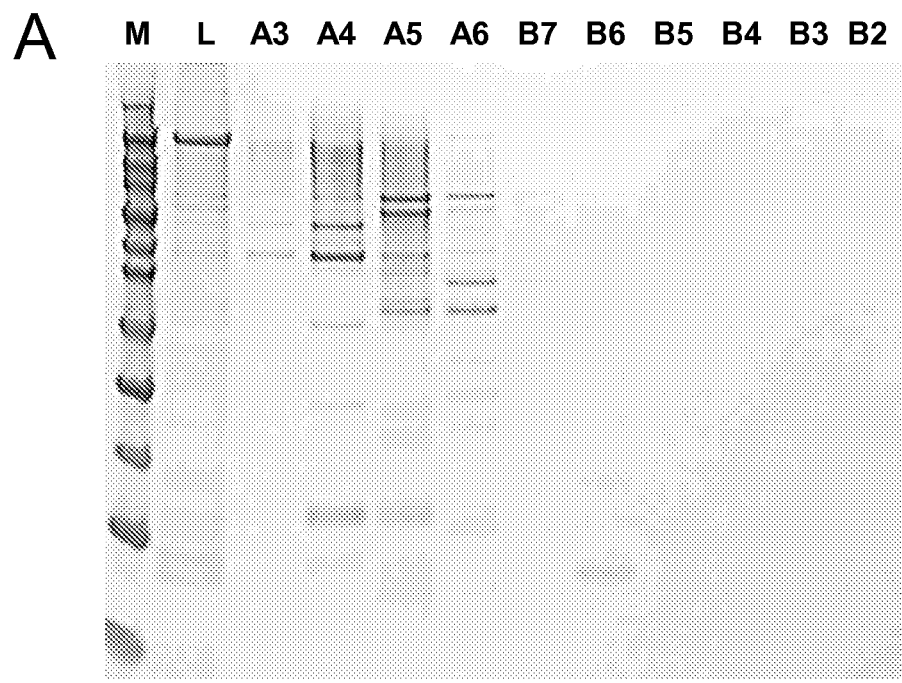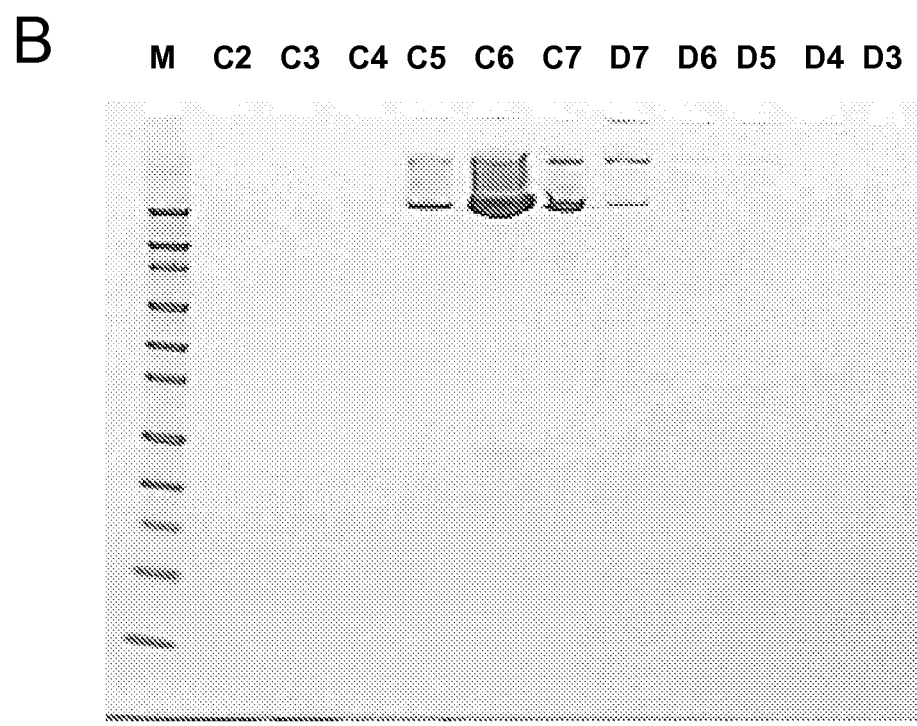
FIG. 48

| Lane 1 | Molecular weight standard |
| Lane 2 | MacroCap SP load |
| Lane 3 | MacroCap SP flow through |
| Lane 4 | MacroCap SP chase |
| Lane 5 | MacroCap SP wash |
| Lane 6 | MacroCap SP elution 1 |
| Lane 7 | MacroCap SP elution 2 |
| Lane 8 | MacroCap SP elution 3 |
| Lane 9 | MacroCap SP elution 4 |
| Lane 10 | MacroCap SP elution 5 |
| Lane 11 | MacroCap SP elution 6 |

A
B
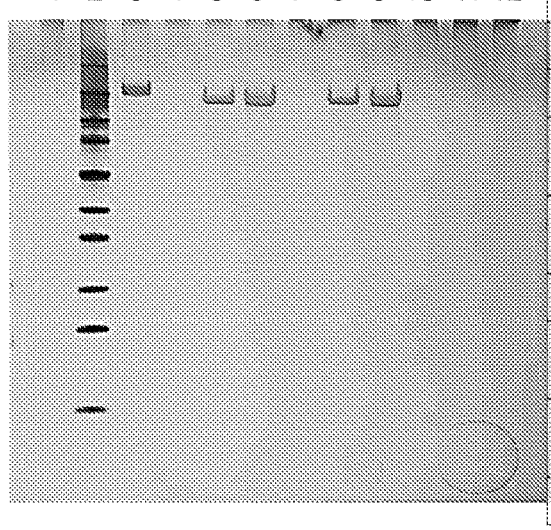
FIG. 63

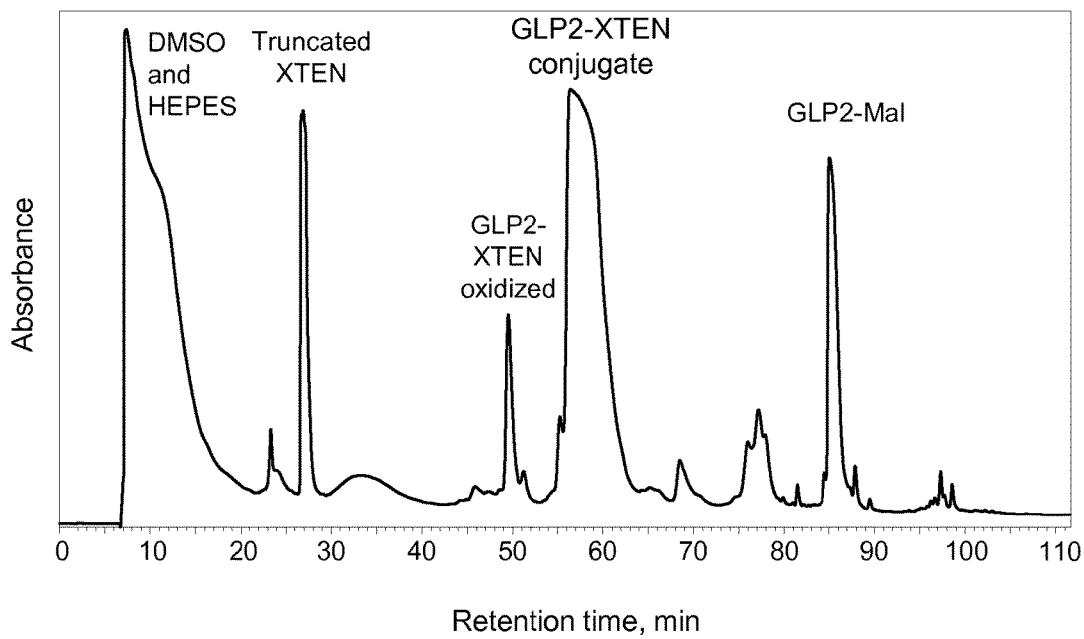
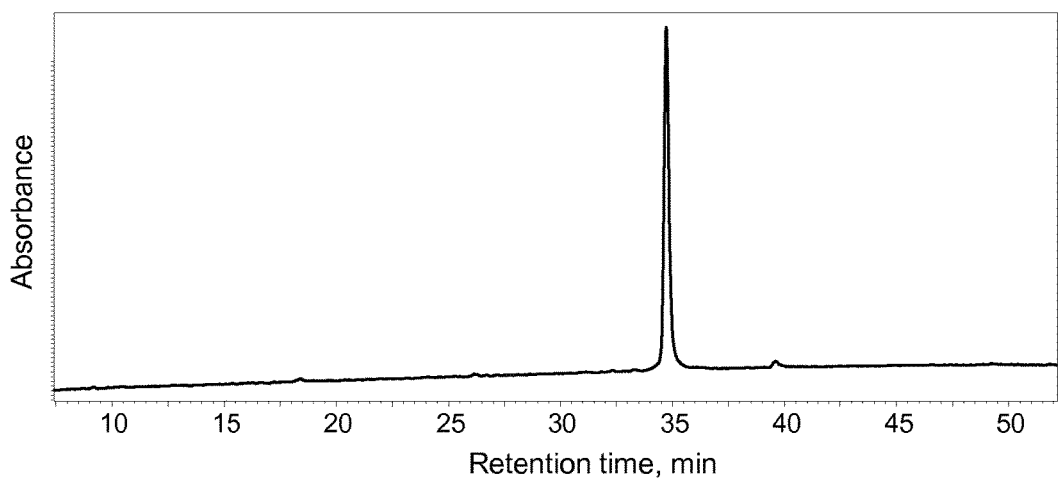
FIG. 70

A.
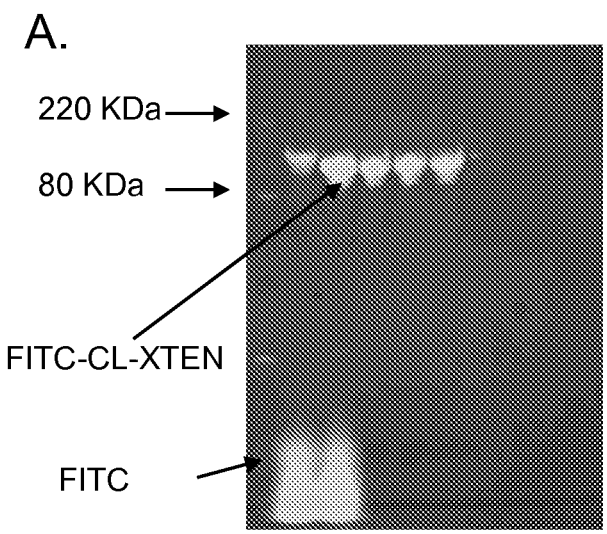
B.
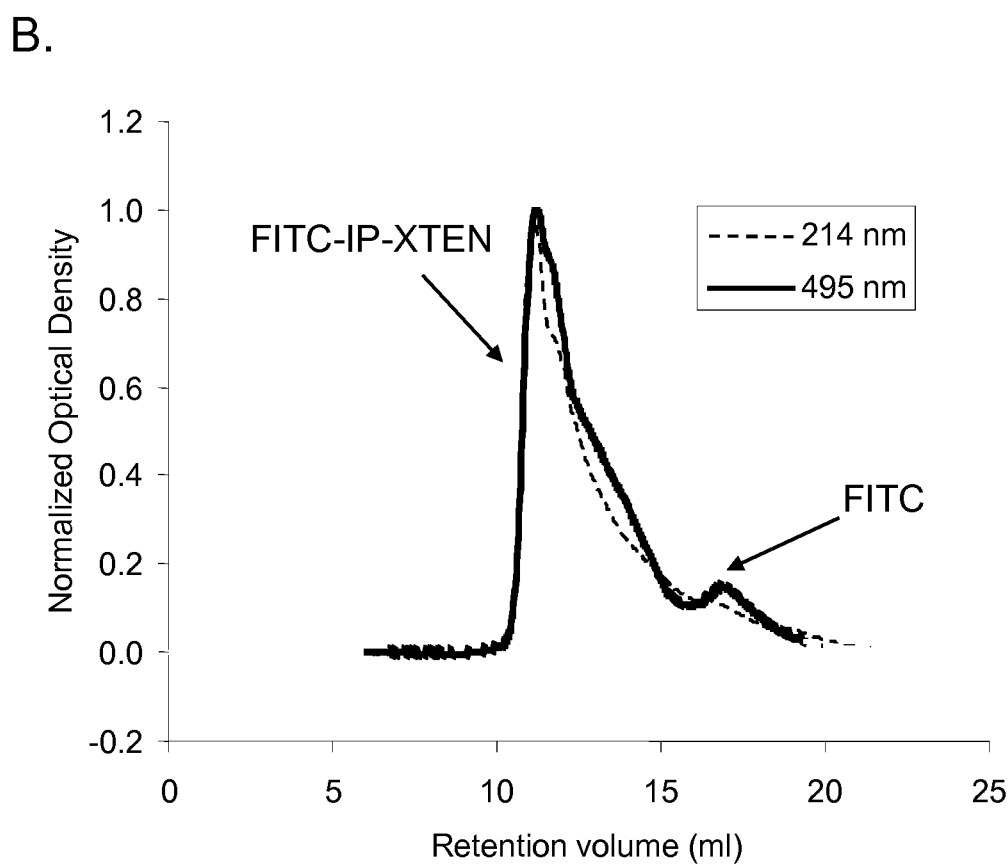
FIG. 72

1. Glucagon-Y288
2. Glucagon-Y144
3. Glucagon-Y72
4. Glucagon-Y36
- - - - = Standards

XTEN Sequence

| 1 | 2 | 3 | 4 | 5 | 6 | 7 | 8 | 9 | 10 | 11 |
|---|---|---|---|---|---|---|---|---|----|----|
| A | S | T | G | E | T | G | E | T | G  | E  |

XTEN Length: N=11

Subsequence length: S=3

|       |     | Seg 1 AST | Seg 2 STG | Seg 3 TGE | Seg 4 GET | Seg 5 ETG | Seg 6 TGE | Seg 7 GET | Seg 8 ETG | Seg 9 TGE |
|-------|-----|-----------|-----------|-----------|-----------|-----------|-----------|-----------|-----------|-----------|
| Seg 1 | AST | x         |           |           |           |           |           |           |           |           |
| Seg 2 | STG |           | x         |           |           |           |           |           |           |           |
| Seg 3 | TGE |           |           | x         |           |           | x         |           |           |           |
| Seg 4 | GET |           |           |           | x         |           |           | x         |           |           |
| Seg 5 | ETG |           |           |           |           | x         |           |           | x         |           |
| Seg 6 | TGE |           |           | x         |           |           | x         |           |           | x         |
| Seg 7 | GET |           |           |           | x         |           |           | x         |           |           |
| Seg 8 | ETG |           |           |           |           | x         |           |           | x         |           |
| Seg 9 | TGE |           |           |           |           |           | x         |           |           | x         |
|       |     | 1         | 1         | 2         | 2         | 2         | 3         | 2         | 2         | 2         |

Subsequence Score = 1.89

FIG. 80

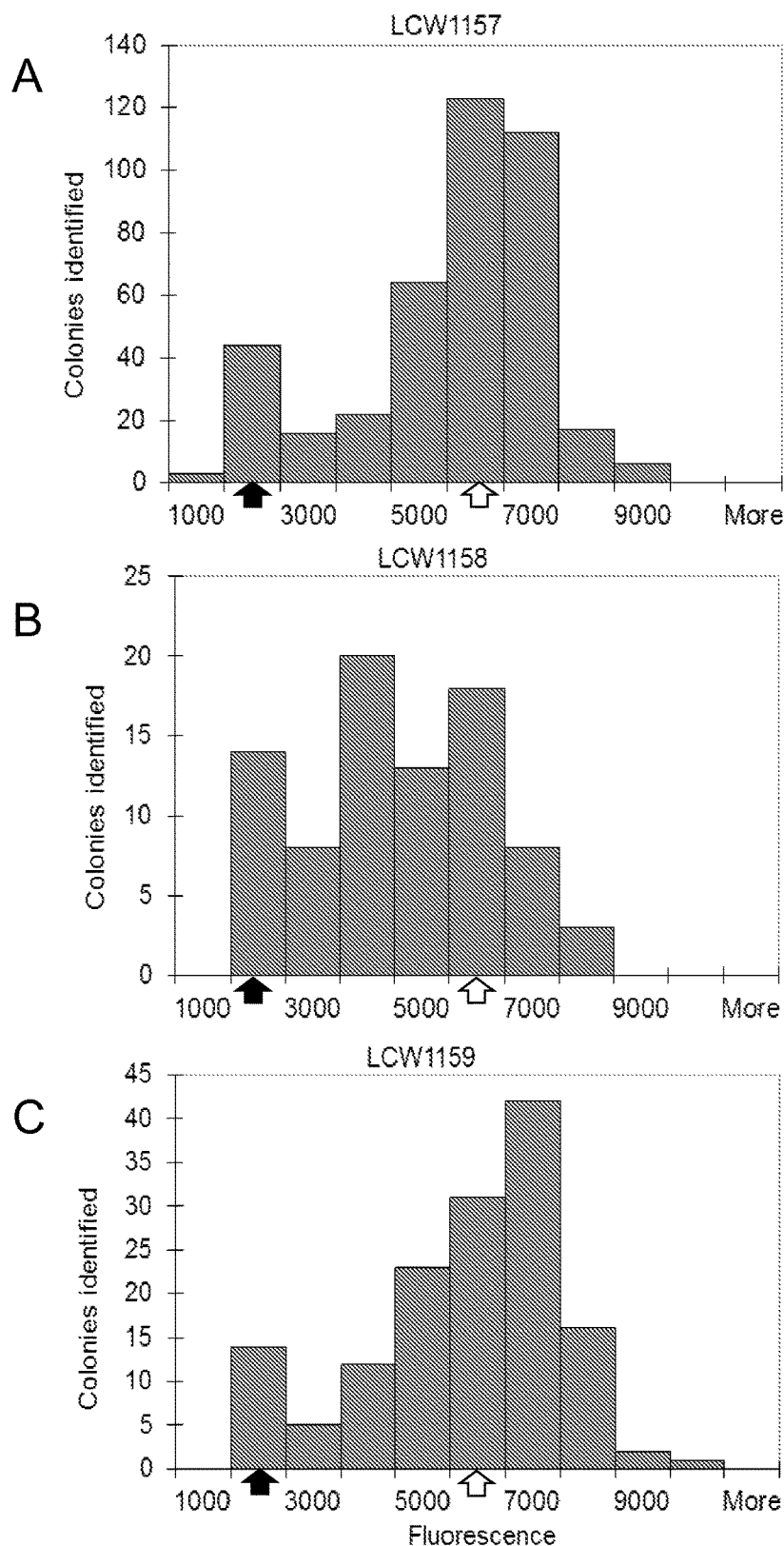
FIG. 82, A, B, C

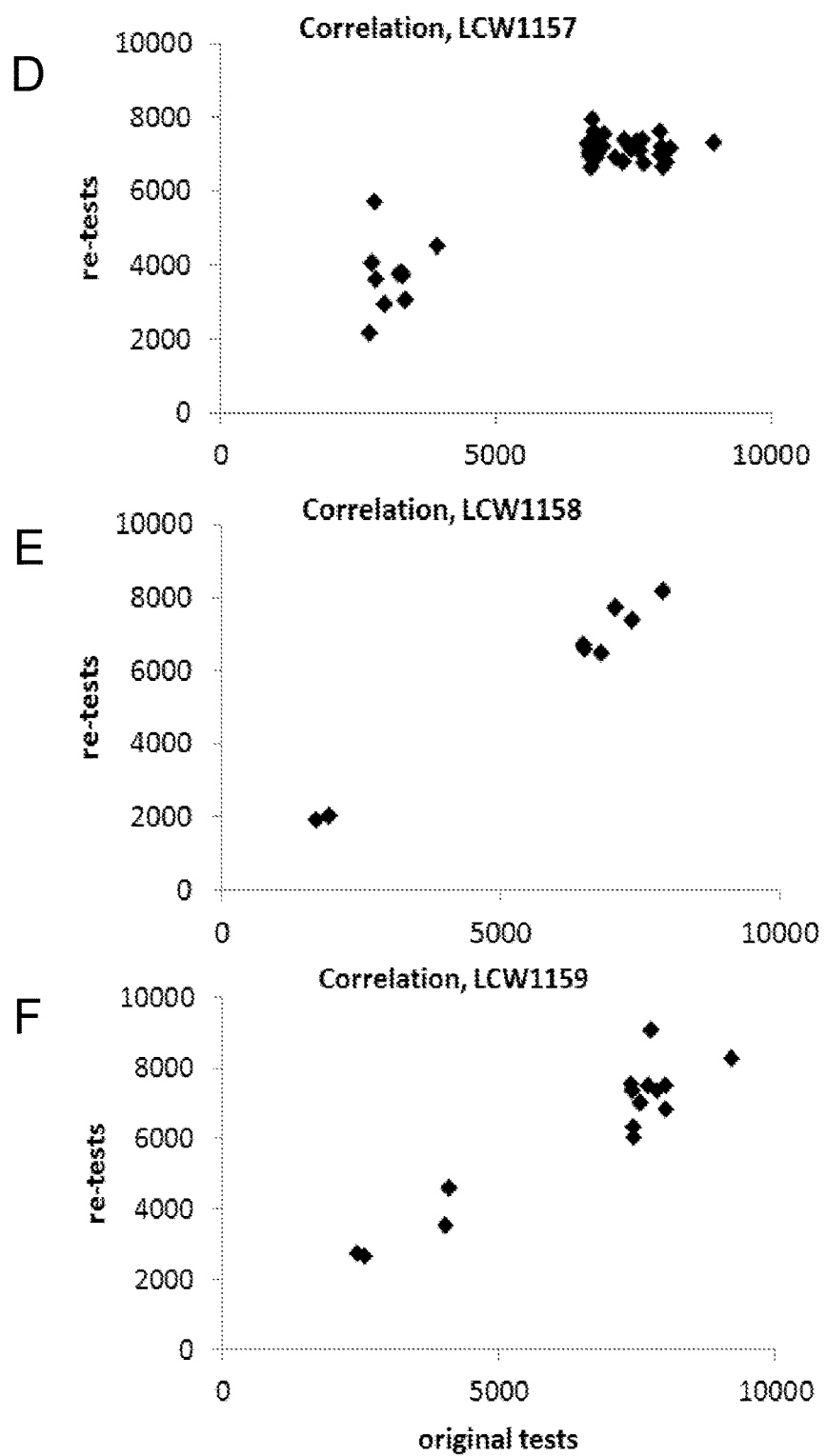
FIG. 82, D, E, F

A
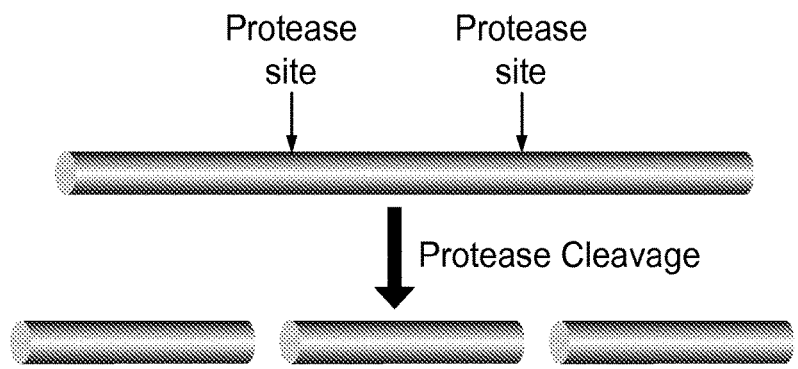
B
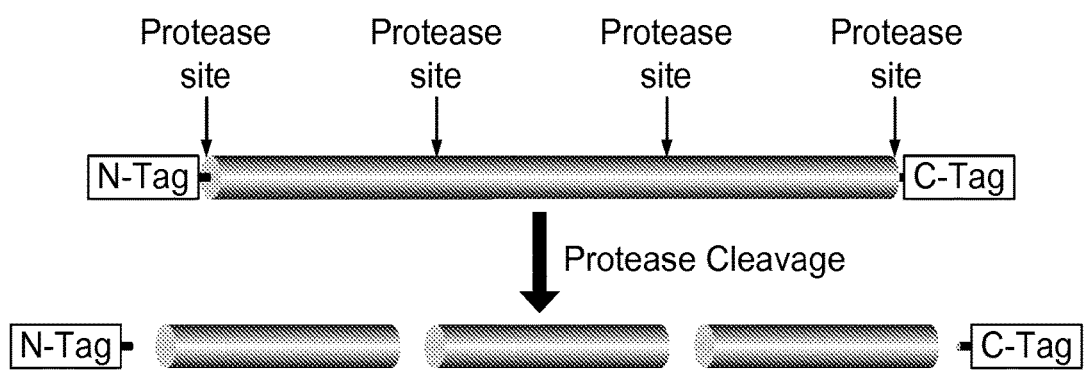
FIG. 96

B
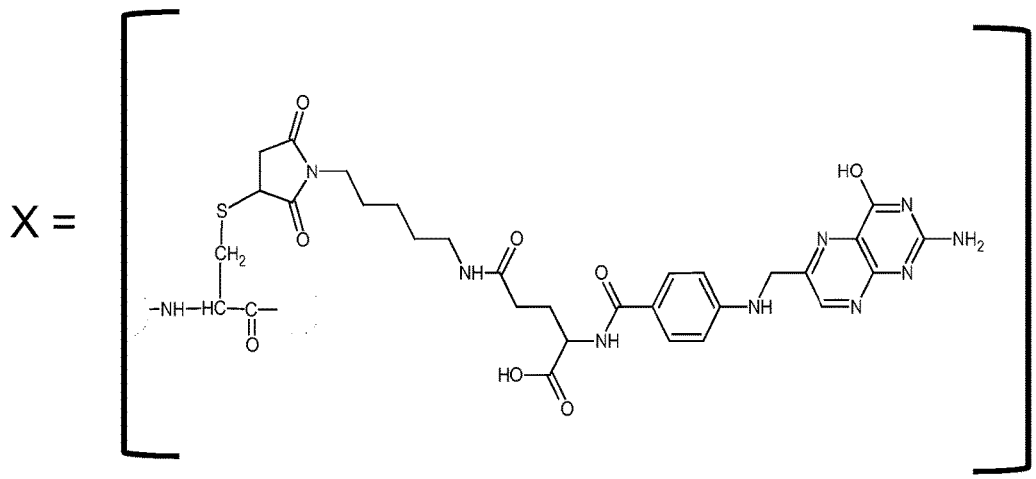
Residue X = residue of Cys modified with Folate-γ-Mal
C
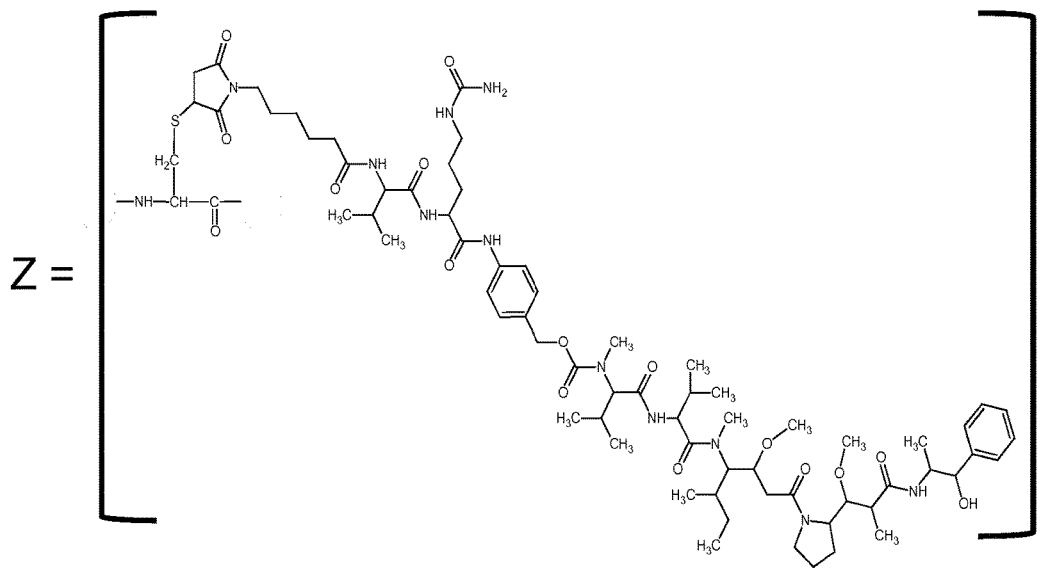
Residue Z = residue of Cys modified with MC-Val-Cit-PAB-MMAE
FIG. 117B, C ically- or biologically-active agents, resulting in XTEN-payload compositions. In one aspect, the invention provides
XTEN CONJUGATE COMPOSITIONS AND METHODS OF MAKING SAME

CROSS-REFERENCE TO RELATED APPLICATION

This application claims priority benefit to U.S. Provisional Application Ser. No. 61/634,312 filed Feb. 27, 2012, U.S. Provisional Application Ser. No. 61/690,187 filed Jun. 18, 2012, and U.S. Provisional Application Ser. No. 61/709, 942 filed Oct. 4, 2012, which applications are incorporated herein by reference.

SEQUENCE LISTING

The instant application contains a Sequence Listing which has been submitted in ASCII format via EFS-Web and is hereby incorporated by reference in its entirety. Said ASCII copy, created on Apr. 10, 2013, is named 32808-736.601_SL.txt and is 2,639,526 bytes in size.

BACKGROUND OF THE INVENTION

Extending the half-life a therapeutic agent, whether being a therapeutic protein, peptide or small molecule, often requires specialized formulations or modifications to the therapeutic agent itself. Conventional modification methods such as pegylation, adding to the therapeutic agent an antibody fragment or an albumin molecule, suffer from a number of profound drawbacks. While these modified forms can be prepared on a large scale, these conventional methods are generally plagued by high cost of goods, complex process of manufacturing, and low purity of the final product. Oftentimes, it is difficult, if not impossible, to purify to homogeneity of the target entity. This is particularly true for pegylation, where the reaction itself cannot be controlled precisely to generate a homogenous population of pegylated agents that carry the same number or mass of polyethyleneglycol. Further, the metabolites of these pegylated agents can have sever side effects. For example, PEGylated proteins have been observed to cause renal tubular vacuolation in animal models (Bendele, A., Seely, J., Richey, C., Sennello, G. & Shopp, G. Short communication: renal tubular vacuolation in animals treated with polyethylene-glycol-conjugated proteins. Toxicol. Sci. 1998. 42, 152-157). Renally cleared PEGylated proteins or their metabolites may accumulate in the kidney, causing formation of PEG hydrates that interfere with normal glomerular filtration. In addition, animals and humans can be induced to make antibodies to PEG (Sroda, K. et al. Repeated injections of PEG-PE liposomes generate anti-PEG antibodies. Cell. Mol. Biol. Lett. 2005.10, 37-47).

Thus, there remains a considerable need for alternative compositions and methods useful for the production of highly pure form of therapeutic agents with extended half-life properties at a reasonable cost.

SUMMARY OF THE INVENTION

The present invention addresses this need and provides related advantages. The compositions and methods disclosed herein not only are useful as therapeutics but are also particularly useful as research tools for preclinical and clinal development of a candidate therapeutic agent. In some aspects, the present invention addresses this need by, in part, generating extended recombinant polypeptide (XTEN) reagents that can be purified to homogeneity with one or a few simple steps, and/or that are amenable to chemical conjugation with payload peptides, proteins and small molecules with reactive groups using a wide diversity of conjugation methods. The use of the XTEN reagents generates high-yield product of XTEN-linked agent that are superior in one or more aspects including high homogeneity, high solubility, long stability, and enhanced terminal half-life compared to unconjugated product.

The present invention relates, in part, to novel compositions comprising substantially homogeneous extended recombinant polypeptides (XTEN) useful as conjugation partners for linking to one or more payload pharmacologically- or biologically-active agents, resulting in XTEN-payload compositions. In one aspect, the invention provides XTEN engineered for covalent linking to the one or more payloads either directly or via cross-linkers, resulting in XTEN-payload composition that comprise 1, 2, 3, 4, 5, 6, 7, 8, 9, or 10 or more molecules of one, two, three or more types of payloads. It is an object of the present invention to provide such engineered XTEN polypeptides for use in creating conjugates with payload agents of interest as compositions with enhanced pharmaceutical properties, including enhanced pharmacokinetic properties. The invention provides XTEN that are substantially homogeneous in length and sequence that are useful for preparing the conjugates comprising the XTEN linked to one or more payloads such that the resulting XTEN-payload conjugates have a high degree of purity. Such conjugates of high purity are useful in preparing pharmaceutical compositions for subjects having a medical condition for which the one or more payloads have utility in the prevention, treatment or amelioration of the condition.

In a first aspect, the invention provides substantially homogenous XTEN polypeptide compositions useful as conjugation partners to create XTEN-cross-linker intermediates and XTEN-payload compositions. In some embodiments, the invention provides a substantially homogenous population of polypeptides comprising an extended recombinant polypeptide (XTEN), and wherein at least 90%, 91%, 92%, 93%, 94%, or 95% of individual polypeptide molecules in said population have identical sequence length. In one embodiment of the foregoing, the XTEN is characterized in that: the total XTEN amino acid residues is at least 36 to about 3000 amino acid residues; the sum of glycine (G), alanine (A), serine (S), threonine (T), glutamate (E) and proline (P) residues constitutes more than about 90% of the total amino acid residues of the XTEN; the XTEN sequence is substantially non-repetitive such that (i) the XTEN sequence contains no three contiguous amino acids that are identical unless the amino acids are serine, (ii) at least about 80%, or about 90%, or about 95% of the XTEN sequence consists of non-overlapping sequence motifs, each of the sequence motifs comprising about 9 to about 14 amino acid residues, wherein any two contiguous amino acid residues does not occur more than twice in each of the sequence motifs; or (iii) the XTEN sequence has a subsequence score of less than 10; the XTEN sequence has greater than 90%, 91%, 92%, 93%, 94%, 95%, 96%, 97%, 98%, or greater than 99% random coil formation as determined by GOR algorithm; the XTEN sequence has less than 2%, or 3%, or 4%, or 5% alpha helices; the XTEN sequence has less than 2%, or 3%, or 4%, or 5% beta-sheets as determined by Chou-Fasman algorithm; and the XTEN sequence lacks a predicted T-cell epitope when analyzed by TEPITOPE algorithm, wherein the TEPITOPE algorithm prediction for epitopes within the XTEN sequence is based on a score of −8, or −9, or −10. In another embodiment of the foregoing, the XTEN comprises a sequence having at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group consisting of the sequences set forth in Table 2, Table 3, Table 4 and Tables 22-25.

In other embodiments, the substantially homogenous XTEN polypeptide compositions comprise one or more affinity tags. In one embodiment, the invention provides a substantially homogenous XTEN polypeptide composition comprising a first affinity tag wherein the first affinity tag has binding affinity for a chromatography substrate selected from the group consisting of hydrophobic interaction chromatography (HIC), cation exchange, anion exchange, immobilized metal ion affinity chromatography (IMAC), and immobilized antibody. In one embodiment of the foregoing, the first affinity tag has at least about 90%, 91%, 92%, 93%, 94%, or at least about 95% sequence identity to a sequence selected from the group consisting of the sequences set forth in Table 7. In another embodiment of the foregoing XTEN and affinity tag, the composition further comprises one or more helper sequences. In one embodiment, a helper sequence comprises a sequence having at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group consisting of the sequences set forth in Table 10. In another embodiment, the helper sequence is selected from the group consisting of: KNPEQAEEQX1EET wherein X1 is independently S or R (SEQ ID NO: 1); ANPEQAEEQX1EET wherein X1 is independently S or R (SEQ ID NO: 2); KNPEQAEEQAEEQX1EET wherein X1 is independently S or R (SEQ ID NO: 3); KX2X3EQAEEQAEEQX1EET wherein X1 is independently S or R, X2 is independently K or N, and X3 is independently K, N, T, Q, H, P, E, D, A, R, or S (SEQ ID NO: 4); KX2(X3)$_{10}$QX1EET wherein X1 is independently S or R, X2 is independently K or N, and X3 is independently K, N, T, Q, H, P, E, D, A, R, or S (SEQ ID NO: 5); KX2(X3)$_{7}$AEEQX1EET wherein X1 is independently S or R, X2 is independently K or N, and X3 is independently K, N, T, Q, H, P, E, D, A, R, or S (SEQ ID NO: 6); KX2X3EQE(X3)$_{3}$AEEQREET wherein X2 is independently K or N, and X3 is independently K, N, T, Q, H, P, E, D, A, R, or S (SEQ ID NO: 7); KX2X3EQE(X3)$_{3}$AEE(X3) wherein X2 is independently K or N, and X3 is independently K, N, T, Q, H, P, E, D, A, R, or S (SEQ ID NO: 8); KKQEQEKEQAEEQ(X4X5)$_{2}$REET wherein X4 is independently A or S and X5 is independently K, Q, or E (SEQ ID NO: 9); KKQEQEKEQAEEQ(X4X5)$_{4}$REET wherein X4 is independently A or S and X5 is independently K, Q, or E (SEQ ID NO: 10); KKQEQEKEQAEEQ(Z)$_{4}$REET, wherein Z is any naturally-occurring L-amino acid (SEQ ID NO: 11); KX2(X3)$_{n}$, wherein n is an integer from 10-40 and X2 is independently K or N, and X3 is independently K, N, T, Q, H, P, E, D, A, R, or S (SEQ ID NO: 12); (X3), wherein n is an integer from 10-50 and X3 is independently K, N, T, Q, H, P, E, D, A, R, or S (SEQ ID NO: 13); KX2QEQEKEQAEEQ(X4X5)$_{n}$X1EET wherein n is zero or an integer from 1-10 and X1 is independently S or R, X2 is independently K or N, X4 is independently A or S, and X5 is independently K, Q, or E (SEQ ID NO: 14); KX2(X3)$_{n}$(X4X5)$_{m}$X1EET, wherein n is an integer from 5-20, m is zero or an integer from 1-10, X1 is independently S or R, X2 is independently K or N, X3 is independently K, N, T, Q, H, P, E, D, A, R, or S, X4 is independently A or S, and X5 is independently K, Q, or E (SEQ ID NO: 15); and KX2(X3)$_{n}$(Z)$_{m}$X1EET, wherein n is an integer from 5-20, m is zero or an integer from 1-10, X1 is independently S or R, X2 is independently K or N, X3 is independently K, N, T, Q, H, P, E, D, A, R, or S, and Z is any naturally-occurring L-amino acid (SEQ ID NO: 16), and any sequence homologs showing at least 80%, 90%, 95%, 98%, or 99% sequence identity of the foregoing when optimally aligned.

In other embodiments of the foregoing substantially homogenous XTEN, affinity tag, and helper sequence compositions, the composition further comprises a first cleavage sequence. Where desired, the cleavage sequence is selected from the group consisting of the sequences set forth in Table 8 and Table 9. In one embodiment of the foregoing, the composition has the configuration of formula I:

(HS)-(AT1)-(CS1)-(XTEN)    I wherein HS is the helper sequence; AT1 is the first affinity tag; CS1 is the first cleavage sequence; and XTEN is the extended recombinant polypeptide. In another embodiment of the foregoing compositions, the composition further comprises a second cleavage sequence. Where desired, the first and the second cleavage sequences are capable of being cleaved by the same protease, and wherein the composition has the configuration of formula II:

(HS)-(CS1)-(XTEN)-(CS2)-(AT1)    II wherein HS is a helper sequence; AT1 is the first affinity tag; CS1 is the first cleavage sequence; CS2 is the second cleavage sequence; and XTEN is the extended recombinant polypeptide. In another embodiment of the foregoing compositions, the first affinity tag comprises the sequence RPRPRPRPRPRPR (SEQ ID NO: 17), HHHHHH (SEQ ID NO: 18), or any affinity tag known in the art or disclosed herein.

In other embodiments of the substantially homogenous XTEN compositions, the compositions comprise a fast and a second affinity tag, a first and a second cleavage sequence, and a helper sequence wherein the second affinity tag is different from the first affinity tag and has binding affinity to a different chromatography substrate than that of the first affinity tag, wherein the chromatography substrate is selected from the group consisting of HIC, cation exchange, anion exchange, IMAC, and immobilized antibody, and wherein the first and the second cleavage sequences are capable of being cleaved by the same protease, and wherein the second affinity tag has at least about 90%, 91%, 92%, 93%, 94%, or at least about 95% sequence identity to a sequence selected from the group consisting of the sequences set forth in Table 7. In one embodiment of the foregoing composition, the composition has the configuration of formula III:

(HS)-(AT1)-(CS1)-(XTEN)-(CS2)-(AT2)    III wherein HS is the helper sequence; AT1 is the first affinity tag; CS1 is the first cleavage sequence; CS2 is the second cleavage sequence; XTEN is the extended recombinant polypeptide; and AT2 is the second affinity tag. In another embodiment of the foregoing composition, the first affinity tag comprises the sequence RPRPRPRPRPRPR (SEQ ID NO: 17) and the second affinity tag comprises the sequence HHHHHH (SEQ ID NO: 18). In another embodiment of the foregoing composition, the first affinity tag comprises the sequence HHHHHH (SEQ ID NO: 18) and the second affinity tag comprises the sequence RPRPRPRPRPRPR (SEQ ID NO: 17). In another embodiment of the foregoing composition, the first affinity tag comprises the sequence RPRPRPRPRPRPRPRPRPRPR (SEQ ID NO: 19) and the second affinity tag comprises the sequence HHHHH-HHH (SEQ ID NO: 20).

In another aspect, the invention provides compositions comprising a substantially homogenous population of a polypeptide obtained by a process. In some embodiments, the compositions are obtained by the process comprising: culturing a host cell that comprises a vector encoding the polypeptide in a fermentation reaction under conditions effective to express the polypeptide by a crude expression product of the host cell, wherein the encoded polypeptide comprises an XTEN, a first cleavage sequence and a first affinity tag; adsorbing the polypeptide of the crude expression product onto a first chromatography substrate under conditions effective to capture the first affinity tag onto the first chromatography substrate; eluting the polypeptide: and recovering the polypeptide. In some embodiments, at least 90%, 91%, 92%, 93%, 94%, or 95% of the polypeptides of the resulting population have identical sequence length. In one embodiment of the foregoing composition, the first chromatography substrate is selected from the group consisting of HIC, cation exchange, anion exchange, and IMAC. In another embodiment of the foregoing composition, the affinity tag is selected from the group consisting of the affinity tags of Table 7. In another embodiment of the foregoing composition the first chromatography substrate is cation exchange and the first affinity tag comprises the sequence RPRPRPRPRPRPR (SEQ ID NO: 17). In another embodiment of the foregoing composition, the first chromatography substrate is IMAC and the first affinity tag comprises the sequence HHHHHHHH (SEQ ID NO: 20). In one embodiment of the foregoing composition, the encoding vector encodes any of the XTEN embodiments described herein comprising at least affinity tag, at least a first cleavage sequence, a helper sequence, and optionally a second cleavage sequence. In another embodiment of the foregoing composition, the vector further encodes a second cleavage sequence and a second affinity tag wherein the first and the second cleavage sequences are capable of being cleaved by the same protease and wherein the second affinity tag has binding affinity to a second, different chromatography substrate than the first affinity tag, and wherein the composition is obtained by the process further comprising: adsorbing the polypeptide onto a second chromatography substrate under conditions effective to capture the second affinity tag onto the second chromatography substrate; eluting the polypeptide; and recovering the polypeptide wherein at least 90%, 91%, 92%, 93%, 94%, or 95% of the polypeptides of the population have identical sequence length. In one embodiment of the foregoing, the first chromatography substrate is different from the second chromatography substrate and each of the first and the second chromatography substrate are independently selected from the group consisting of HIC, cation exchange, anion exchange, and IMAC. In another embodiment of the foregoing composition, the first chromatography substrate is cation exchange and the first affinity tag comprises the sequence RPRPRPRPRPRPR (SEQ ID NO: 17) or RPRPRPRPRPRPRPRPRPRPR (SEQ ID NO: 19) and the second chromatography substrate is IMAC and the first affinity tag comprises the sequence HHHHHHHH (SEQ ID NO: 20) or HHHHHHHH (SEQ ID NO: 20). In another embodiment of the foregoing composition, the first chromatography substrate is IMAC and the first affinity tag comprises the sequence HHHHHHHH (SEQ ID NO: 20) or HHHHHHHH (SEQ ID NO: 20) and the second chromatography substrate is cation exchange and the first affinity tag comprises the sequence RPRPRPRPRPRPR (SEQ ID NO: 17) or RPRPRPRPRPRPRPRPRPRPR (SEQ ID NO: 19). In another embodiment, the foregoing compositions comprising a first or a first and a second affinity tag are further processed by treating the composition with a protease under conditions effective to cleave the cleavage sequence(s), thereby releasing the XTEN from the affinity tag(s); adsorbing the XTEN onto a chromatography substrate under conditions effective to capture the XTEN but not the affinity tag(s) or the protease; eluting the XTEN; and recovering the XTEN. At least 90%, 91%, 92%, 93%, 94%, or 95% of the individual molecules of XTEN in the resulting composition have identical sequence length. In one embodiment of the foregoing composition, the cleavage sequence(s) are capable of being cleaved by a protease selected from the group consisting of the proteases of Table 9. In another embodiment of the foregoing composition, the cleavage sequence(s) are capable of being cleaved by trypsin and the protease is trypsin. In another embodiment of the foregoing composition, the chromatography substrate is anion exchange. The anion exchange substrate can be a substrate selected from the group consisting of macrocap Q, capto Q, superQ-650M, and poros D. Alternatively, the foregoing compositions comprising one affinity tag or two affinity tags are further processed by treating the composition under conditions effective to cleave the cleavage sequence(s), thereby releasing the XTEN from the one or two affinity tags; adsorbing the protease onto a chromatography substrate under conditions effective to capture the protease and the affinity tags but not the XTEN; and recovering the XTEN from the eluate. In some embodiments, at least 90%, 91%, 92%, 93%, 94%, or 95% of the individual molecules of XTEN of the resulting eluate have identical sequence length. In one embodiment of the foregoing composition, the cleavage sequence(s) are capable of being cleaved by a protease selected from the group consisting of the proteases of Table 9. In another embodiment of the foregoing composition, the cleavage sequence(s) are capable of being cleaved by trypsin and the protease utilized is trypsin. The chromatography substrate can be selected from one or more of cation exchange, HIC or IMAC.

In another aspect, the invention relates, in part, to polypeptide compositions that can be cleaved into XTEN segments of equal length and sequence. In one embodiment, the invention provides a composition comprising an XTEN sequence, wherein the XTEN sequence further comprises one or more cleavage sequences capable of being cleaved by trypsin and wherein treatment with trypsin under conditions effective to cleave all the cleavage sequences results in a preparation of XTEN fragments wherein each XTEN fragment has at least about 99% sequence identity to every other fragment in the preparation. In one embodiment of the composition, the cleavage sequence has at least 86% sequence identity to or is identical to the sequence SASRSA (SEQ ID NO: 21) or SASKSA (SEQ ID NO: 22). In another embodiment of the composition, the cleavage sequence comprises the sequence RX or KX, wherein X is any L-amino acid other than proline. In one embodiment of the foregoing compositions, the XTEN composition has at least about 90%, 91%, 92%, 93%, 94%, 95%, 96%, 97%, 98%, 99% or 100% sequence identity to the sequences selected from the group of sequences set forth in Table 6.

In another aspect, the invention relates, in part, to methods for producing XTEN fragments substantially of equal length and sequence. In one embodiment, the invention provides a method of producing a substantially homogenous population of an XTEN, the method comprising treating a population of polypeptides comprising a sequence selected from the group of sequences set forth in Table 6 with trypsin under conditions effective to cleave all of the cleavage sequence(s) resulting in a substantially homogenous XTEN population wherein at least 90%, 91%, 92%, 93%, 94%, or 95% of individual molecules of the XTEN fragments have identical sequence length. In one embodiment of the foregoing method, the method further comprises adsorbing the XTEN fragments onto a chromatography substrate under conditions effective to capture the XTEN fragments but not the protease; eluting the XTEN fragments; and recovering the XTEN fragments wherein at least 90%, 91%, 92%, 93%, 94%, or 95% of individual molecules of the population have identical sequence length. In one embodiment of the foregoing method, the chromatography substrate is anion exchange. The substrate can be selected from the group consisting of macrocap Q, capto Q, superQ-650M, and poros D. In another embodiment of the foregoing method, the XTEN has at least about 90%, 91%, 92%, 93%, 94%, 95%, 96%, 97%, 98%, or 99% sequence identity to a sequence selected from the group of sequences set forth in Table 6. In another embodiment of the foregoing method, the resulting XTEN fragment has at least about 90%, 91%, 92%, 93%, 94%, 95%, 96%, 97%, 98%, or 99% sequence identity to a sequence selected from the group of sequences set forth in Table 2 or 3. In another embodiment, the invention provides XTEN compositions made by the process of the foregoing method embodiments.

In another aspect, the invention relates, in part, to methods for producing XTEN at high expression yields from a host cell. In some embodiments, the invention provides a method comprising culturing a host cell that comprises a vector encoding a polypeptide comprising the XTEN and a helper sequence in a fermentation reaction under conditions effective to express the polypeptide as a component of a crude expression product at a concentration of more than about 2 grams/liter (g/L), or about 3 g/L, or about 4 g/L, or about 5 g/L, or about 6 g/L, or about 7 g/L of said polypeptide. In one embodiment of the foregoing method, the foregoing expression yields are achieved when the fermentation reaction reaches an optical density of at least 100, or at least 130, or at least 150 at a wavelength of 600 nm. In another embodiment, the invention provides a method for comprising culturing a host cell that comprises a vector encoding a polypeptide comprising the XTEN and a helper sequence in a fermentation reaction under conditions effective to express the polypeptide as a component of a crude expression product at a concentration of more than about 10 milligrams/gram of dry weight host cell (mg/g), or at least about 15 mg/g, or at least about 20 mg/g, or at least about 25 mg/g, or at least about 30 mg/g, or at least about 40 mg/g, or at least about 50 mg/g of said polypeptide. In one embodiment of the foregoing method, the foregoing high-yield expression is achieved when the fermentation reaction reaches an optical density of at least 100, or at least 130, or at least 150 at a wavelength of 600 nm. In another embodiment, the invention provides a method comprising culturing a host cell that comprises a vector encoding a polypeptide comprising the XTEN and a helper sequence in a fermentation reaction under conditions effective to express the polypeptide as a component of a crude expression product at a concentration of more than about 10 milligrams/gram of dry weight host cell (mg/g), or at least about 250 micromoles/L, or about 300 micromoles/L, or about 350 micromoles/L, or about 400 micromoles/L, or about 450 micromoles/L, or about 500 micromoles/L of said polypeptide. In one embodiment of the foregoing method, the foregoing expression yields are achieved when the fermentation reaction reaches an optical density of at least 100, or at least 130, or at least 150 at a wavelength of 600 nm. In one embodiment of the foregoing methods, the helper sequence of the expressed polypeptide is at the N-terminus of the polypeptide, wherein the helper sequence has at least about 90%, 91%, 92%, 93%, 94%, or 95% sequence identity or is identical to a sequence selected from the group consisting of the sequences set forth in Table 10. In another embodiment of the foregoing methods, expression vector further encodes a first affinity tag and a cleavage sequence between the affinity tag and the XTEN, and the method further comprises recovering the crude expression product of the host cell fermentation reaction mixture; adsorbing the polypeptide of the crude expression product onto a first chromatography substrate under conditions effective to capture the first affinity tag of the polypeptide onto the chromatography substrate wherein the first chromatography substrate is selected from the group consisting of HIC, cation exchange, anion exchange, and IMAC; eluting and recovering the polypeptide wherein at least 90%, 91%, 92%, 93%, 94%, or 95% of the polypeptides have identical sequence length. In another embodiment of the foregoing methods, expression vector further encodes a first affinity tag and a second affinity tag different from the first tag and a cleavage sequence between each affinity tag and the XTEN, and the method further comprises recovering the crude expression product of the host cell fermentation reaction mixture; adsorbing the polypeptide onto a first chromatography substrate under conditions effective to capture the first affinity tag of the polypeptide onto the chromatography substrate wherein the first chromatography substrate is selected from the group consisting of HIC, cation exchange, anion exchange, and IMAC; eluting the polypeptide; adsorbing the polypeptide onto a second chromatography substrate under conditions effective to capture the second affinity tag of the polypeptide onto the chromatography substrate wherein the second chromatography substrate is selected from the group consisting of HIC, cation exchange, anion exchange, and IMAC; eluting the polypeptide; and recovering the polypeptide wherein at least 90%, 91%, 92%, 93%, 94%, or 95% of the polypeptides have identical sequence length. In one embodiment of the foregoing methods, the methods further comprise treating the polypeptide with a protease under conditions effective to cleave the cleavage sequence(s), thereby releasing the XTEN from the polypeptide; adsorbing the XTEN onto an anion chromatography substrate under conditions effective to capture the XTEN; eluting the XTEN; and recovering the XTEN wherein at least 90%, or at least 91%, or at least 92%, or at least 93%, or at least 94%, or at least 95% of the individual XTEN molecules have identical sequence length. In the foregoing methods, the anion exchange substrate can be selected from the group consisting of macrocap Q, capto Q, superQ-650M. and poros D. In one embodiment of the foregoing methods, the cleavage sequences are capable of being cleaved by trypsin and the protease is trypsin. In another embodiment of the foregoing methods, the method further comprises treating the polypeptide with a protease under conditions effective to cleave the cleavage sequence(s), thereby releasing the XTEN from the polypeptide; adsorbing the protease onto a chromatography substrate under conditions effective to capture the protease and the affinity tags but not the XTEN; and recovering the XTEN in the eluate wherein at least 90%, 91%, 92%, 93%, 94%, or 95% of the XTEN have identical sequence length. In one embodiment of the foregoing method, the cleavage sequence is capable of being cleaved by trypsin and the protease utilized is trypsin. In the foregoing method to capture the protease and the affinity tag, the chromatography substrate can be selected from one or more of HIC, cation exchange, and IMAC.

In another aspect, the invention relates, in part, to a solid support comprising immobilized thereon a population of substantially identical XTEN polypeptide molecules. In one embodiment, the invention provides a solid support comprising immobilized thereon a population of substantially identical polypeptide molecule wherein the solid support comprises a chromatography substrate, immobilized polypeptides each comprising an XTEN, a first affinity tag, and a second affinity tag wherein the first affinity tag is joined to the XTEN by a cleavage sequence at the N-terminus of the XTEN and the second affinity tag is joined to the XTEN by a cleavage sequence at the C-terminus and wherein the second affinity tag is different from the first affinity tag, wherein the chromatography substrate is capable of binding to either said first or said second affinity tag but not both, and wherein at least 90%, 91%, 92%, 93%, 94%, or 95% of the immobilized polypeptide molecules have identical sequence length. In one embodiment of the XTEN comprises a sequence having at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group consisting of the sequences set forth in Table 2, Table 3, Table 4 and Tables 22-25, the first and the second affinity tag each independently have at least about 90%, 91%, 92%, 93%, 94%, or at least about 95% sequence identity to a sequence selected from the group consisting of the sequences set forth in Table 7, and the cleavage sequence is selected from the group consisting of the sequences set forth in Table 8 and Table 9. In one embodiment of the foregoing the cleavage sequence has at least about 86% sequence identity to or is identical to the sequence SASRSA (SEQ ID NO: 21) or SASKSA (SEQ ID NO: 22). In one embodiment of the foregoing the cleavage sequence comprises the sequence RX or KX, wherein X is any L-amino acid other than proline. In one embodiment of the foregoing, the solid support is selected from the group consisting of HIC chromatography resin, cation exchange chromatography resin, anion exchange chromatography resin, and IMAC chromatography resin. In one embodiment of the foregoing, the first affinity tag comprises the sequence RPRPRPRPRPRPR (SEQ ID NO: 17) or RPRPRPRPRPRPRPRPRPR (SEQ ID NO: 19) and the second affinity tag comprises the sequence HHHHHH (SEQ ID NO: 18) or HHHHHHHH (SEQ ID NO: 20). In another embodiment of the foregoing, the first affinity tag comprises the sequence HHHHHH (SEQ ID NO: 18) or HHHHHHHH (SEQ ID NO: 20) and the second affinity tag comprises the sequence RPRPRPRPRPRPR (SEQ ID NO: 17) or RPRPRPRPRPRPRPRPRPR (SEQ ID NO: 19).

In another aspect, the invention relates, in part, to compositions of XTEN conjugated to cross-linkers. In some embodiments, the invention provides compositions of any of the XTEN described herein that is covalently linked to one or more molecules of at least a first cross-linker, wherein the cross-linker is selected from the group consisting of the cross-linkers set forth in Table 13, the alkyne reactants set forth in Table 15, and the azide reactants set forth in Table 15. In one embodiment of the conjugate composition, the first cross-linker is conjugated to the at least first XTEN at a location selected from the group consisting of: an alpha-amino group of an N-terminal amino acid residue of the XTEN; an epsilon amino group of each lysine residue of the XTEN; and a thiol group of each cysteine residue of the XTEN. Where desired, the XTEN in this embodiment has at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group of sequences set forth in Table 2 and Table 3. In another embodiment of the conjugate composition, the XTEN is selected from the group consisting of AE144, AE288, AE432, AE576, AE864, Seg 174, Seg 175, Seg 176, Seg 177, Seg 186, Seg 187, Seg 188, Seg 189, Seg 190, Seg 191, Seg 192, Seg 193, Seg 194, Seg 195, Seg 196, Seg 197, Seg 198, and Seg 199, and the cross-linker is conjugated to the alpha amino-group of the N-terminal amino acid of the XTEN. In another embodiment of the conjugate composition, the XTEN is selected from the group consisting of Seg 174, Seg 175, Seg 176, Seg 177, Seg 186, Seg 187, Seg 188, Seg 189, Seg 190, Seg 191, Seg 192, Seg 193, Seg 194, Seg 195, Seg 196, Seg 197, Seg 198, and Seg 199 set forth in Table 3, and the cross-linker is conjugated to the thiol group of each cysteine residue of the XTEN. In another embodiment of the conjugate composition, the first cross-linker is selected from the group consisting of N-maleimide, iodoacetyl, pyridyl disulfide and vinyl sulfone, 3-propargyloxypropanoic acid, (oxyethyl)$_n$-acetylene where n is 1-10, dibenzylcyclooctyne (DBCO), cyclooctyne (COT), 3-azide-propionic acid, 6-azide-hexanoic acid, and (oxyethyl)$_n$-azide where n is 1-10. In the foregoing embodiments of this paragraph, the conjugate has the configuration of formula IV:

wherein independently for each occurrence CL$_1$ is the cross-linker; x is an integer from 1 to about 100, or 1 to about 50, or 1 to about 40, or 1 to about 20, or 1 to about 10, or 1 to about 5, or is 9, or is 3, or is 2, or is 1. Where desired, the XTEN in this embodiment comprises a sequence having at least about 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3. In one embodiment of the conjugate of formula IV, CL1 is a cross-linker selected from Table 13. In other embodiments of the XTEN-crosslinker conjugate compositions, the compositions further comprise a single atom residue of a first payload conjugated to each first cross-linker wherein the residue is selected from the group consisting of carbon, nitrogen, oxygen and sulfur. In one embodiment of the foregoing, the first payload of the single atom residue can be selected from the group consisting of the payloads set forth in Tables 11, 12, 18, and 21. In other embodiments of the XTEN-crosslinker conjugate compositions, the compositions further comprise a payload selected from the group consisting of the payloads set forth in Tables 11 and 12 conjugated to each first cross-linker.

In other embodiments of the XTEN-crosslinker conjugate compositions, the invention provides compositions of an XTEN of the embodiments described herein covalently linked to one or more molecules of a first cross-linker and one or more molecules of a second cross-linker, wherein the first cross-linker is conjugated to either the thiol groups of each cysteine residue of the XTEN or to the epsilon amino groups of the each lysine residue of the XTEN, and the second cross-linker conjugated to alpha amino-group of the N-terminal amino acid of the XTEN wherein each cross-linker is independently selected from the group consisting of the cross-linkers set forth in Table 13, the alkyne reactants of Table 15, and the azide reactants of Table 15. In the foregoing embodiment, the composition has the configuration of formula V:

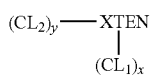

V wherein independently for each occurrence; CL1 is the first cross-linker conjugated to cysteine residues of the XTEN; CL2 is the second cross-linker conjugated to XTEN at the N-terminus; x is an integer of 1 to about 10; y is an integer of 1 with the proviso that x+y is ≥2; and XTEN is either a cysteine engineered XTEN comprising x number of cysteine residues or a lysine engineered XTEN comprising x number of lysine residues. In another embodiments of the XTEN-cross-linker conjugate compositions, the compositions further comprise a single atom residue of a first payload conjugated to each of the first cross-linkers wherein the residue is selected from the group consisting of carbon, nitrogen, oxygen and sulfur and a single atom residue of a second payload conjugated to each of the second cross-linkers wherein the residue is selected from the group consisting of carbon, nitrogen, oxygen and sulfur. In one embodiment of the foregoing, the first payload of the single atom residue can be selected from the group consisting of the payloads set forth in Tables 11, 12, 18, and 21 and the second payload of the single atom residue can be independently selected from the group consisting of the payloads set forth in Tables 11, 12, 18, and 21. In some embodiments of the XTEN-cross-linker-payload residue composition, the composition has the configuration of formula VI:

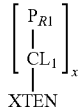

VI wherein independently for each occurrence $P_{R1}$ is a single atom residue of a payload, wherein the residue is selected from the group consisting of carbon, nitrogen, oxygen and sulfur, $CL_1$ is a cross-linker, x is an integer from 1 to about 100, or 1 to about 50, or 1 to about 40, or 1 to about 20, or 1 to about 10, or 1 to about 5, or is 3, or is 2, or is 1. Where desired, the XTEN in this embodiment comprises a sequence having at least about 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3. In one embodiment of the conjugate of formula VI, the single atom residue of a payload is from a payload selected from the group consisting of the payloads set forth in Tables 11, 12, 18, 19, and 21. In one embodiment of the conjugate of formula VI, $CL_1$ is a cross-linker selected from Table 13. In one embodiment of the conjugate of formula VI, each cross-linker is linked to a cysteine sulfur of the XTEN. In another embodiment of the conjugate of formula VI, each cross-linker is linked to a lysine epsilon amino group of the XTEN. In another embodiment of the conjugate of formula VI, x is 1 and the cross-linker is linked to the N-terminal amino group of the XTEN. In another embodiment of the conjugate of formula VI, $CL_1$ is the reaction product of a first and a second click chemistry reactant selected from Table 15. In another embodiment, the invention provides a preparation of the conjugate of formula VI in which at least about 80%, or at least about 90%, or at least about 91%, or at least about 92%, or at least about 93%, or at least about 94%, or at least about 95% of the XTEN molecules of the preparation of the conjugate have identical sequence length. In other embodiments of the XTEN-cross-linker conjugate compositions, the compositions further comprise a first payload conjugated to each of the first cross-linkers wherein the payload is selected from the group consisting of the payloads set forth in Tables 11, 12, 18, and 21, and a second payload different from the first payload conjugated to the second cross-linker wherein the second payload is selected from the group consisting of payloads set forth in Tables 11, 12, 18, and 21. In one embodiment of the XTEN-crosslinker-payload conjugate composition, the composition comprises a first payload conjugated to each of the first cross-linkers wherein the payload is selected from the group consisting drug moieties of Table 21, and a second payload different from the first payload conjugated to the second cross-linker wherein the second payload is selected from the group consisting of targeting moieties of Table 21. In one embodiment of the XTEN-crosslinker-payload conjugate composition with a first and a second payload, a single second payload is linked to the N-terminus of the XTEN by the second cross-linker conjugated by reaction of an alkyne reactant and an azide reactant selected from the group consisting of the reactants of Table 15. In some embodiments of the XTEN-cross-linker-payload composition, the composition has the configuration of formula VII:

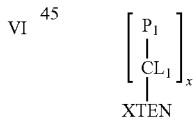

VII wherein independently for each occurrence: $P_1$ is a payload selected from the group consisting of the payloads set forth in Tables 11, 12, 18, 19, and 21; $CL_1$ is a cross-linker; x is an integer from 1 to about 100, or 1 to about 50, or 1 to about 40, or 1 to about 20, or 1 to about 10, or 1 to about 5, or is 9, or is 3, or is 2, or is 1; and XTEN is a sequence having at least about 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3. In one embodiment of the conjugate of formula VII, $CL_1$ is a cross-linker selected from Table 13. In one embodiment of the conjugate of formula VII, each cross-linker is linked to a cysteine sulfur of the XTEN. In another embodiment of the conjugate of formula VII, each cross-linker is linked to an lysine epsilon amino group of the XTEN. In another embodiment of the conjugate of formula VII, x is 1 and the cross-linker is linked to the N-terminal amino group of the XTEN. In one embodiment, the conjugate of formula VII is selected from the group consisting of the conjugates set forth in Table 21. In another embodiment of the conjugate of formula VII, $CL_1$ is the reaction product of a first and a second click chemistry reactant selected from Table 15. It will be understood by one of skill in the art that the compositions of the foregoing embodiments comprising the payload conjugated to an XTEN-cross-linker using the specified components represents the reaction product of the reactants and thus differs from the precise composition of the reactants. In another embodiment, the invention provides a preparation of the conjugate of formula VII in which at least about 80%, or at least about 90%, or at least about 91%, or at least about 92%, or at least about 93%, or at least about 94%, or at least about 95% of the XTEN molecules of the preparation of the conjugate have identical sequence length.

In another aspect, the invention relates, in part, to compositions of a first and a second XTEN conjugated to each other. In some embodiments, the conjugate composition comprises a first and a second XTEN, wherein the XTEN are the same or they are different and each independently has at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group of sequences set forth in Table 3, and in which the first and the second XTEN are conjugated to each other by the N-termini of the first and the second XTEN with a cross-linker created by reaction of an alkyne reactant and an azide reactant selected from the group consisting of the reactants of Table 15, resulting in a dimeric XTEN conjugate. In one embodiment of the dimeric XTEN composition, at least 90%, 91%, 92%, 93%, 94%, or 95% of the individual molecules of each of the first XTEN have identical sequence length and at least 90%, 91%, 92%, 93%, 94%, or 95% of the individual molecules of each of the second XTEN have identical sequence length. In one embodiment of the dimeric XTEN conjugate, the first XTEN has at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group of sequences consisting of Seg 174, Seg 175, Seg 176, Seg 177, Seg 186, Seg 187, Seg 188, Seg 189, Seg 190, Seg 191, Seg 192, Seg 193, Seg 194, Seg 195, Seg 196, Seg 197, Seg 198, and Seg 199 set forth in Table 3 and the second XTEN has at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a different sequence selected from the group of sequences consisting of Seg 174, Seg 175, Seg 176, Seg 177, Seg 186, Seg 187, Seg 188, Seg 189, Seg 190, Seg 191, Seg 192, Seg 193, Seg 194, Seg 195, Seg 196, Seg 197, Seg 198, and Seg 199 set forth in Table 3. In another embodiment of the dimeric XTEN conjugate, the first XTEN and the second XTEN are the same and each has at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group of sequences set forth in Table 3. In another embodiment of the dimeric XTEN conjugate, the first XTEN and the second XTEN are the same are each has at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group of sequences consisting of Seg 174, Seg 175, Seg 176, Seg 177, Seg 186, Seg 187, Seg 188, Seg 189, Seg 190, Seg 191, Seg 192, Seg 193, Seg 194, Seg 195, Seg 196, Seg 197, Seg 198, and Seg 199 set forth in Table 3. In another embodiment of the dimeric XTEN conjugate, the first and the second XTEN each comprises one or more cysteine residues, and further comprises a first cross-linker conjugated to each cysteine residue of the first XTEN and a second cross-linker conjugated to each cysteine residue of the second XTEN, wherein the first and the second cross-linkers are independently selected from the group consisting of the cross-linkers set forth in Table 13. In another embodiment of the dimeric XTEN conjugate, the first and the second XTEN each comprises one or more lysine residues, and further comprises a cross-linker conjugated to each lysine residue of the first and the second XTEN of the conjugate, wherein the cross-linker is selected from the group consisting of the cross-linkers set forth in Table 13. In another embodiment of the dimeric XTEN conjugated to cross-linkers, the conjugate further comprises a single atom residue of a first payload conjugated to each cross-linker of the first XTEN wherein the residue is selected from the group consisting of carbon, nitrogen, oxygen and sulfur, and further comprises a single atom residue of a second payload conjugated to each cross-linker of the second XTEN wherein the residue is selected from the group consisting of carbon, nitrogen, oxygen and sulfur. In the foregoing embodiment, the first payload of the single atom residue can be selected from the group consisting of the payloads set forth in Tables 11, 12, 18, and 21, and the second payload of the single atom residue is a different payload from the first payload and can be selected from the group consisting of the payloads set forth in Tables 11, 12, 18, and 21. In some embodiments of the dimeric XTEN-cross-linker-payload residue composition, the composition has the configuration of formula X

wherein independently for each occurrence $P_{R1}$ is a single atom residue of a first payload wherein the residue is selected from the group consisting of carbon, nitrogen, oxygen and sulfur; $P_{R2}$ is a single atom residue of a second payload wherein the residue is selected from the group consisting of carbon, nitrogen, oxygen and sulfur, $CL_1$ is a cross-linker; x is an integer from 1 to about 100, or 1 to about 50, or 1 to about 40, or 1 to about 20, or 1 to about 10, or 1 to about 5, or is 9, or is 3, or is 2, or is 1; $CL_2$ is a cross-linker that is different from $CL_1$; y is an integer from 1 to about 100, or 1 to about 50, or 1 to about 40, or 1 to about 20, or 1 to about 10, or 1 to about 5, or is 9, or is 3, or is 2, or is 1, with the proviso that x+y is ≥2; 2×CL is alternatively a divalent cross-linker or the reaction product of a first and a second click chemistry reactant selected from Table 15; XTEN$_1$ is a polypeptide having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3; and XTEN$_2$ is a polypeptide having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3. In one embodiment of the conjugate of formula X, CL$_1$ and CL$_2$ are each selected from the group of cross-linkers set forth in Table 13. In another embodiment of the conjugate of formula X, x is 1 and CL$_1$ is linked to the N-terminal amino group of the XTEN. In another embodiment of the conjugate of formula X, CL$_1$ is the reaction product of a first and a second click chemistry reactant selected from Table 15. In another embodiment of the conjugate of formula X, C$_2$ is the reaction product of a first azide and a second alkyne click chemistry reactant selected from Table 15. In another embodiment of the conjugate of formula X, each CL$_1$ is linked to a cysteine sulfur of the XTEN$_1$ and each CL$_2$ is linked to a cysteine sulfur of XTEN$_2$. In another embodiment of the conjugate of formula X, each CL$_1$ is linked to a lysine epsilon amino group of the XTEN$_1$ and each CL$_2$ is linked to a lysine epsilon amino group of the XTEN$_2$. In another embodiment of the conjugate of formula X, each CL$_1$ is linked to a cysteine sulfur of the XTEN$_1$ and each CL$_2$ is linked to a lysine epsilon amino group of the XTEN$_2$. In another embodiment of the conjugate of formula X, XTEN$_1$ and XTEN$_2$ are identical. In another embodiment of the conjugate of formula X, XTEN$_1$ and XTEN$_2$ are different. In another embodiment, the invention provides a preparation of the conjugate of formula X in which at least about 80%, or at least about 90%, or at least about 91%, or at least about 92%, or at least about 93%, or at least about 94%, or at least about 95% of the XTEN molecules of the preparation of the conjugate have identical sequence length. In another embodiment of the dimeric XTEN conjugated to cross-linkers, the composition further comprises a first payload conjugated to each cross-linker of the first XTEN wherein the first payload is selected from the group consisting of the payloads set forth in Tables 11, 12, 18, and 21, and further comprises a second payload different from the first payload wherein the second payload is conjugated to each cross-linker of the second XEN wherein the second payload is selected from the group consisting of the payloads set forth in Tables 11, 12, 18, and 21. In another embodiment of the dimeric XTEN conjugated to cross-linkers, the composition further comprises a first payload conjugated to each cross-linker of the first XTEN wherein the first payload is selected from the group consisting of the targeting moieties set forth in Table 18 or Table 21, and further comprises a second payload different from the first payload wherein the second payload is conjugated to each cross-linker of the second XTEN wherein the second payload is selected from the group of toxins set forth in Table 18 or Table 21. In another embodiment of the dimeric XTEN conjugated to cross-linkers and a first and a second payload, the first XTEN is Seg 176 set forth in Table 3 and the second XTEN is selected from the group consisting of Seg 176 and Seg 177 set forth in Table 3. In some embodiments of the dimeric XTEN-cross-linker-payload composition, the composition has the configuration of formula XI

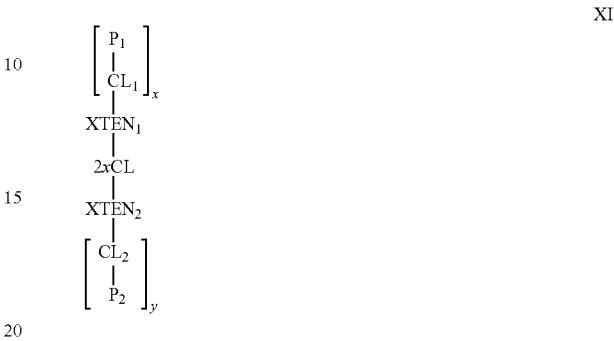

wherein independently for each occurrence P$_1$ is a first payload selected from the group of payloads set forth in Tables 11, 12, 18, 19, and 21; P$_2$ is a second payload selected from the group of payloads set forth in Tables 11, 12, 18, 19, and 21 and that is different from P$_1$; CL$_1$ is a cross-linker, x is an integer from 1 to about 100, or 1 to about 50, or 1 to about 40, or 1 to about 20, or 1 to about 10, or 1 to about 5, or is 9, or is 3, or is 2, or is 1; CL$_2$ is a cross-linker that is different from CL$_1$; y is an integer from 1 to about 100, or 1 to about 50, or 1 to about 40, or 1 to about 20, or 1 to about 10, or 1 to about 5, or is 9, or is 3, or is 2, or is 1, with the proviso that x+y is ≥2; 2×CL is alternatively a divalent cross-linker or the reaction product of a first and a second click chemistry reactant selected from Table 15; XTEN$_1$ is a first substantially homogeneous XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3; and XTEN$_2$ is a first substantially homogeneous having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3. In one embodiment of the conjugate of formula XI, CL$_1$ and CL$_2$ are each selected from the group of cross-linkers set forth in Table 13. In another embodiment of the conjugate of formula XI, x is 1 and CL$_1$ is linked to the N-terminal amino group of the XTEN. In another embodiment of the conjugate of formula XI, CL$_1$ is the reaction product of a first and a second click chemistry reactant selected from Table 15. In another embodiment of the conjugate of formula XI, C$_2$ is the reaction product of a first and a second click chemistry reactant selected from Table 15. In another embodiment of the conjugate of formula XI, each CL$_1$ is linked to a cysteine sulfur of the XTEN$_1$ and each CL$_2$ is linked to a cysteine sulfur of XTEN$_2$. In another embodiment of the conjugate of formula XI, each CL$_1$ is linked to a lysine epsilon amino group of the XTEN$_1$ and each CL$_2$ is linked to a lysine epsilon amino group of the XTEN$_2$. In another embodiment of the conjugate of formula XI, each CL$_1$ is linked to a cysteine sulfur of the XTEN$_1$ and each CL$_2$ is linked to a lysine epsilon amino group of the XTEN$_2$. In another embodiment of the conjugate of formula XI, XTEN$_1$ and XTEN$_2$ are identical. In another embodiment of the conjugate of formula XI, XTEN$_1$ and XTEN$_2$ are different. In one embodiment, the conjugate of formula XI is selected from the group consisting of the conjugates set forth in Table 21. In another embodiment, the invention provides a preparation of the conjugate of formula XI in which at least about 80%, or at least about 90%, or at least about 91%, or at least about 92%, or at least about 93%, or at least about 94%, or at least about 95% of the respective XTEN$_1$ and XTEN$_2$ molecules of the preparation of the conjugate have identical sequence length.

In another aspect, the invention relates, in part, to compositions of a first and a second and a third XTEN conjugated to each other, resulting in trimeric conjugate compositions. In some embodiments, the conjugate compositions comprise a first and a second and a third XTEN wherein the XTEN may be the same or they may be different, and in which the first and the second and the third XTEN are conjugated to each other by the N-terminus using a trivalent cross-linker selected from the group consisting of the trivalent cross-linkers set for in Table 13 or Table 14. In one embodiment of the trimeric conjugate, the first and the second and the third XTEN are identical or are different and each has at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group of sequences set forth in either Table 2 or Table 3. In another embodiment of the trimeric conjugate, the first and the second and the third XTEN are identical or are different and at least 90%, 91%, 92%, 93%, 94%, or 95% of the individual molecules of each of the first XTEN have identical sequence length and at least 90%, 91%, 92%, 93%, 94%, or 95% of the individual molecules of each of the second XTEN have identical sequence length and at least 90%, 91%, 92%, 93%, 94%, or 95% of the individual molecules of each of the third XTEN have identical sequence length. In another embodiment of the trimeric conjugate the trivalent cross-linker is selected from the group consisting of Tris-(2-Maleimidoethyl)amine (TMEA) and amine-reactive Tris-(succimimidyl aminotricetate) (TSAT). In another embodiment of the trimeric conjugate, the first and the second and the third XTEN are identical and each has at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group consisting of Seg 174, Seg 175, Seg 176, Seg 177, Seg 186, Seg 187, Seg 188, Seg 189, Seg 190, Seg 191, Seg 192, Seg 193, Seg 194, Seg 195, Seg 196, Seg 197, Seg 198, and Seg 199 set forth in Table 3. In another embodiment of the trimeric conjugate, the first and the second and the third XTEN are identical and each has at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group consisting of Seg 174, Seg 175, Seg 176, Seg 177, Seg 186, Seg 187, Seg 188, Seg 189, Seg 190, Seg 191, Seg 192, Seg 193, Seg 194, Seg 195, Seg 196, Seg 197, Seg 198, and Seg 199 set forth in Table 3, and the third XTEN is different from the first and the second XTEN and has at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group consisting of Seg 174, Seg 175, Seg 176, Seg 177, Seg 186, Seg 187, Seg 188, Seg 189, Seg 190, Seg 191, Seg 192, Seg 193, Seg 194, Seg 195, Seg 196, Seg 197, Seg 198, and Seg 199 set forth in Table 3. In another embodiment of the trimeric conjugate, each XTEN comprises at least a first cysteine residue and the conjugate further comprises a first cross-linker conjugated to each cysteine residue of the first XTEN, a second cross-linker conjugated to each cysteine residue of the second XTEN, and a third cross-linker conjugated to each cysteine residue of the third XTEN, wherein the cross-linker is selected from the group consisting of the cross-linkers set forth in Table 13. In some embodiments of the trimeric conjugate, the composition has the configuration of formula XII:

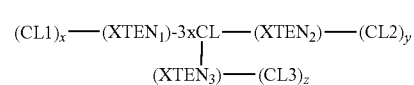

wherein independently for each occurrence; 3×CL is the trivalent cross-linker; CL1 is the first cross-linker conjugated to XTEN$_1$; CL2 is the second cross-linker conjugated to XTEN$_2$; CL3 is the third cross-linker conjugated to XTEN$_3$; x is an integer of 1 to about 10; y is an integer of 1 to about 10; z is an integer of 1 to about 10 with the proviso that x+y+z is ≥3; XTEN$_1$ is the first XTEN; XTEN$_2$ is the second XTEN; and XTEN$_3$ is the third XTEN. In another embodiment of the trimeric conjugate, the conjugate further comprises a single atom residue of a first payload conjugated to each first cross-linker of the first XTEN wherein the residue is selected from the group consisting of carbon, nitrogen, oxygen and sulfur, a single atom residue of a second payload conjugated to each second cross-linker of the second XTEN wherein the residue is selected from the group consisting of carbon, nitrogen, oxygen and sulfur, and a single atom residue of a third payload conjugated to each third cross-linker of the third XTEN wherein the residue is selected from the group consisting of carbon, nitrogen, oxygen and sulfur. In another embodiment of the trimeric conjugate composition, the composition further comprises a first payload conjugated to each first cross-linker of the first XTEN selected from the group consisting of the payloads set forth in Tables 11, 12, 18 and 21; a second payload conjugated to each second cross-linker of the second XTEN selected from the group consisting of the payloads set forth in Tables 11, 12, 18 and 21, wherein the payload is the same or is different from the first payload; and a third payload conjugated to each third cross-linker of the third XTEN selected from the group consisting of the payloads set forth in Tables 11, 12, 18 and 21, wherein the payload is the same or is different from the first or the second payload. In one embodiment of the trimeric XTEN-payload conjugate composition, the first payload is a targeting moiety with specific binding affinity to a target, wherein the targeting moiety is selected from the group consisting of the targeting moieties set forth in Tables 17-19 and 21, and the second and the third payloads are a drug, which may be the same or may be different and wherein the drug is selected from the group consisting of the drugs set forth in Table 11, Table 18, and Table 21. In one embodiment of the trimeric XTEN-payload conjugate composition wherein the first payload is a targeting moiety with specific binding affinity to a target and the second payload and the third payload is a drug, the targeting moiety is selected from the group consisting of LHRH and folate and the drug is selected from the group consisting of doxorubicin, paclitaxel, auristatin, monomethyl auristatin E (MMAE), monomethyl auristatin F, maytansine, dolastatin, calicheamicin, vinca alkaloid, camptothecin, mitomycin C, epothilone, hTNF, Il-12, bortezomib, ranpirnase, pseudomonas exotoxin, SN-38, and rachelmycin. In one embodiment of the trimeric XTEN-payload conjugate composition wherein the first payload is a targeting moiety with specific binding affinity to a target and the second payload and the third payload is a drug, the targeting moiety, and the drug moiety correspond to any one of conjugates 1-290 set forth in Table 21. In another embodiment of the trimeric XTEN-payload conjugate composition wherein the first payload is a targeting moiety with specific binding affinity to a target and the second payload and the third payload is a drug, the conjugate has the XTEN, the targeting moiety, and the drug moiety corresponding to conjugate 71 of Table 21. In another embodiment of the trimeric XTEN-payload conjugate composition, the composition has the configuration of formula XIII

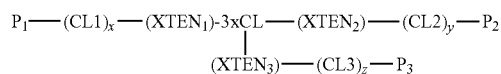

XIII wherein independently or each occurrence 3×CL is the trivalent cross-linker is selected from the group of trivalent cross-linkers set forth in Tables 13 and 14; $P_1$ is conjugated to each cross-linker of the first XTEN and is selected from the group consisting of the payloads set forth in Tables 11, 12, 18 and 21, P2 is a second payload conjugated to each cross-linker of the second XTEN and is selected from the group consisting of the payloads set forth in Tables 11, 12, 18 and 21, wherein the payload is the same or is different from the first payload, and $P_3$ is a third payload conjugated to each cross-linker of the third XTEN and is selected from the group consisting of the payloads set forth in Tables 11, 12, 18 and 21, wherein the payload is the same or is different from the first or the second payload; $CL_1$ is the first cross-linker; x is an integer from 1 to about 100, or 1 to about 50, or 1 to about 40, or 1 to about 20, or 1 to about 10, or 1 to about 5, or is 9, or is 3, or is 2, or is 1; CL2 is a second cross-linker; y is an integer from 1 to about 100, or 1 to about 50, or 1 to about 40, or 1 to about 20, or 1 to about 10, or 1 to about 5, or is 9, or is 3, or is 2, or is 1; and z is an integer from 1 to about 100, or 1 to about 50, or 1 to about 40, or 1 to about 20, or 1 to about 10, or 1 to about 5, or is 9, or is 3, or is 2, or is 1, with the proviso that x+y+z is ≥3; $XTEN_1$ is the first XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3; $XTEN_2$ is the second XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3; and $XTEN_3$ is the third XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3 wherein $XTEN_1$, $XTEN_2$, and $XTEN_3$ are the same or are different XTEN sequences. In some embodiments, the conjugate of formula XIII further comprises a first payload wherein the payload is a targeting moiety with specific binding affinity to a target, wherein the targeting moiety is selected from the group consisting of the targeting moieties set forth in Tables 17-19 and 21, and at least one other of the payloads is a drug wherein the drug is selected from the group consisting of the drugs set forth in Table 11, Table 19, and Table 21. In one embodiment of the foregoing, the targeting moiety is LHRH or folate and the drug is selected from doxorubicin, paclitaxel, auristatin, monomethyl auristatin E (MMAE), monomethyl auristatin F, maytansine, dolastatin, calicheamicin, vinca alkaloid, camptothecin, mitomycin C, epothilone, hTNF, 11-12, bortezomib, ranpirnase, pseudomonas exotoxin, SN-38, and rachelmycin. In another embodiment of the trimeric XTEN conjugate composition, the composition has the configuration of formula XIV:

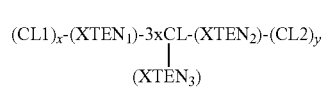

XIV wherein independently for each occurrence; 3×CL is the trivalent cross-linker; CL1 is the first cross-linker conjugated to $XTEN_1$; CL2 is the second cross-linker conjugated to $XTEN_2$; x is an integer of 1 to about 10; y is an integer of 1 to about 10 with the proviso that x+y is ≥2; $XTEN_1$ is the first XTEN; $XTEN_2$ is the second XTEN; and $XTEN_3$ is the third XTEN wherein the XTEN is selected from the group consisting of the sequences set forth in Table 2. In one embodiment of the trimeric XTEN conjugate composition of formula XVI, the composition further comprises a single atom residue of a first payload conjugated to each first cross-linker of the first XTEN wherein the residue is selected from the group consisting of carbon, nitrogen, oxygen and sulfur; and a single atom residue of a second payload conjugated to each second cross-linker of the second XTEN wherein the residue is selected from the group consisting of carbon, nitrogen, oxygen and sulfur. In another embodiment of the trimeric XTEN conjugate composition of formula XVI, the composition further comprises a first payload conjugated to each first cross-linker of the first XTEN selected from the group consisting of the payloads set forth in Tables 11, 12, 18 and 21; and a second payload conjugated to each second cross-linker of the second XTEN selected from the group consisting of the payloads set forth in Tables 11, 12, 18 and 21, wherein the payload is the same or is different from the first payload. In one embodiment of the foregoing, the first payload is a targeting moiety with specific binding affinity to a target, wherein the targeting moiety is selected from the group consisting of the targeting moieties set forth in Tables 17-19 and 21, and the second payloads is a drug selected from the group consisting of the drugs set forth in Table 6, Table 18, and Table 21. In another embodiment of the foregoing, the first payload is a targeting moiety is selected from the group consisting of LHRH and folate, and the second payload is a drug is selected from the group consisting of doxorubicin, paclitaxel, auristatin, monomethyl auristatin E (MMAE), monomethyl auristatin F, maytansine, dolastatin, calicheamicin, vinca alkaloid, camptothecin, mitomycin C, epothilone, hTNF, 11-12, bortezomib, ranpirnase, pseudomonas exotoxin, SN-38, and rachelmycin. In one embodiment of the foregoing, the first payload is a drug selected from the group consisting of the drugs of Table 11 and the proteins of Table 12 and the second payload is different from the first payload and is selected from the group consisting of the drugs of Table 11 and the proteins of Table 12. In another embodiment of the foregoing, the first payload and the second payload are identical and are selected from the group consisting of the drugs of Table 11 and the proteins of Table 12. In another embodiment of the trimeric XTEN conjugate composition, the composition has the configuration of formula XV:

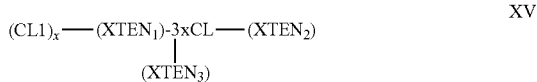

wherein independently for each occurrence; 3xCL is a trivalent cross-linker linking $XTEN_1$, $XTEN_2$, $XTEN_3$; CL1 is the first cross-linker conjugated to $XTEN_1$; x is an integer of 1 to about 10; $XTEN_1$ is the first XTEN wherein the XTEN is selected from the group consisting of the sequences set forth in Table 3; $XTEN_2$ is the second XTEN wherein the XTEN is selected from the group consisting of the sequences set forth in Table 2; and $XTEN_3$ is the third XTEN wherein the XTEN is selected from the group consisting of the sequences set forth in Table 2. In one embodiment of the trimeric XTEN conjugate composition configured as formula XVII, the composition further comprises a single atom residue of a first payload conjugated to each first cross-linker of the first XTEN wherein the residue is selected from the group consisting of carbon, nitrogen, oxygen and sulfur. In one embodiment of the trimeric XTEN conjugate composition configured as formula XVII, the composition further comprises a first payload conjugated to each first cross-linker of the first XTEN selected from the group consisting of the payloads set forth in Tables 11, 12, 18 and 21.

In another aspect, the invention relates, in part, to compositions of a first, a second, a third and a fourth XTEN conjugated to each other, resulting in tetrameric conjugate compositions. In some embodiments, the conjugate compositions comprise a first and a second and a third and a fourth XTEN wherein the XTEN are selected from the group consisting of the sequences set forth in Table 3, wherein the XTEN may be the same or they may be different, and in which the first and the second and the third and the fourth XTEN are conjugated to each other by the N-terminus using a tetravalent cross-linker wherein the tetravalent cross-linker is a tetravalent maleimide cluster. In one embodiment of the tetrameric conjugate, the first and the second and the third and the fourth XTEN are identical or are different and each has at least about 90%0, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group of sequences set forth in either Table 2 or Table 3. In another embodiment of the tetrameric conjugate, the first and the second and the third XTEN are identical or are different and at least 90%, 91%, 92%, 93%, 94%, or 95% of the individual molecules of each of the first XTEN have identical sequence length and at least 90%, 91%, 92%, 93%, 94%, or 95% of the individual molecules of each of the second XTEN have identical sequence length and at least 90%, 91%, 92%, 93%, 94%, or 95% of the individual molecules of each of the third XTEN have identical sequence length and at least 90%, 91%, 92%, 93%, 94%, or 95% of the individual molecules of each of the fourth XTEN have identical sequence length. In another embodiment of the tetrameric conjugate the first, the second, the third, and the fourth XTEN are the same and each has at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group consisting of Seg 174, Seg 175, Seg 176, Seg 177, Seg 186, Seg 187, Seg 188, Seg 189, Seg 190, Seg 191, Seg 192, Seg 193, Seg 194, Seg 195, Seg 196, Seg 197, Seg 198, and Seg 199 set forth in Table 3. In another embodiment of the tetrameric conjugate, the first and the second XTEN are the same and each has at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group consisting of Seg 174, Seg 175, Seg 176, Seg 177, Seg 186, Seg 187, Seg 188, Seg 189, Seg 190, Seg 191, Seg 192, Seg 193, Seg 194, Seg 195, Seg 196, Seg 197, Seg 198, and Seg 199 set forth in Table 3, and the third and the fourth XTEN are the same but are different from the first and the second XTEN and each has at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group consisting of Seg 174, Seg 175, Seg 176, Seg 177, Seg 186, Seg 187, Seg 188, Seg 189, Seg 190, Seg 191, Seg 192, Seg 193, Seg 194, Seg 195, Seg 196, Seg 197, Seg 198, and Seg 199 set forth in Table 3. In another embodiment of the tetrameric conjugate, each XTEN comprises at least a first cysteine residue and the conjugate further comprises a first cross-linker conjugated to each cysteine residue of the first XTEN, a second cross-linker conjugated to each cysteine residue of the second XTEN, a third cross-linker conjugated to each cysteine residue of the third XTEN, and a fourth cross-linker conjugated to each cysteine residue of the fourth XTEN, wherein each cross-linker is selected from the group consisting of the cross-linkers set forth in Table 13. In some embodiments of the tetrameric conjugate compositions, the composition has the configuration of formula XVI

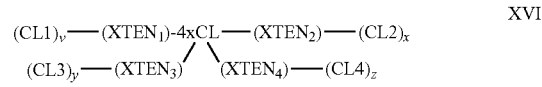

wherein independently for each occurrence: 4xCL is the tetravalent cross-linker, CL1 is the first cross-linker conjugated to $XTEN_1$; CL2 is the second cross-linker conjugated to $XTEN_2$; CL3 is the third cross-linker conjugated to $XTEN_3$; CL4 is the fourth cross-linker conjugated to $XTEN_4$; v is an integer of 1 to about 10; x is an integer of 1 to about 10; y is an integer of 1 to about 10; z is an integer of 1 to about 10 with the proviso that x+y+z is ≥4; $XTEN_1$ is the first XTEN; $XTEN_2$ is the second XTEN; $XTEN_3$ is the third XTEN; and $XTEN_3$ is the fourth XTEN. In another embodiment of the tetrameric conjugate composition, the composition further comprises a single atom residue of a first payload conjugated to each first cross-linker of the first XTEN wherein the residue is selected from the group consisting of carbon, nitrogen, oxygen and sulfur; a single atom residue of a second payload conjugated to each second cross-linker of the second XTEN wherein the residue is selected from the group consisting of carbon, nitrogen, oxygen and sulfur, a single atom residue of a third payload conjugated to each third cross-linker of the third XTEN wherein the residue is selected from the group consisting of carbon, nitrogen, oxygen and sulfur; and a single atom residue of a fourth payload conjugated to each fourth cross-linker of the fourth XTEN wherein the residue is selected from the group consisting of carbon, nitrogen, oxygen and sulfur. In another embodiment of the tetrameric conjugate composition, the composition further comprises a first payload conjugated to each first cross-linker of the first XTEN selected from the group consisting of the payloads set forth in Tables 11, 12, 18, and 21; a second payload conjugated to each second cross-linker of the second XTEN selected from the group consisting of the payloads set forth in Tables 11, 12, 18, and 21, wherein the payload is the same or is different from the first payload; a third payload conjugated to each third cross-linker of the third XTEN selected from the group consisting of the payloads set forth in Tables 11, 12, 18, and 21, wherein the payload is the same or is different from the first or the second payload; and a fourth payload conjugated to each fourth cross-linker of the fourth XTEN selected from the group consisting of the payloads set forth in Tables 11, 12, 18, and 21, wherein the payload is the same or is different from the first or the second or the third payload. In one embodiment of the tetrameric XTEN-payload conjugate composition, the first payload is a targeting moiety with specific binding affinity to a target wherein the targeting moiety is selected from the group consisting of the targeting moieties set forth in Tables 17-19 and 21, and at least one other of the second, third, and fourth payloads is a drug wherein the drug is selected from the group consisting of the drugs set forth in Tables 11, 18 and 21. In one embodiment of the tetrameric XTEN-payload conjugate composition, the first payload is a targeting moiety wherein the targeting moiety is selected from the group consisting of LHRH and folate, and at least one of the second, third and fourth payload is a drug selected from the group consisting of doxorubicin, paclitaxel, auristatin, maytansine, dolastatin, calicheamicin, vinca alkaloid, camptothecin, mitomycin C, epothilone, hTNF, Il-12, bortezomib, ranpirnase, pseudomonas exotoxin, SN-38, and rachelmycin. In another embodiment of the tetrameric XTEN-payload conjugate composition, the first payload is a targeting moiety with specific binding affinity to a target wherein the targeting moiety is selected from the group consisting of the targeting moieties set forth in Tables 17-19 and 21, and at least one other of the second, third, and fourth payloads is a drug wherein the drug is selected from the group consisting of the drugs set forth in Tables 11, 18 and 21, and wherein the XTEN, the targeting moiety, and the drug moiety correspond to any one of conjugates 1-290 set forth in Table 21.

In another aspect, the invention relates, in part, to compositions comprising multimeric XTEN molecules configured in a branched manner, wherein a solution of the composition has a reduced. In one embodiment, the invention provides a composition comprising a solution that comprises a multimeric XTEN having at least three XTEN fragments linked together in a branched manner (e.g. trimeric manner) wherein the viscosity of the solution is reduced by at least 5, 6, 7, 8, 9 or 10 cP in a solution containing ≥100, 130, or 150 mg/ml of the trimeric XTEN preparation compared to a solution containing ≥100, 130, or 150 mg/ml of the corresponding linear XTEN of equal molar concentration. In another embodiment, the invention provides a composition comprising a solution that comprises a multimeric XTEN having at least four XTEN fragments linked together in a branched manner (e.g. tetrameric manner) wherein the composition has a viscosity that is less than a solution comprising a corresponding linear XTEN having the same number of amino acids and the same molar concentration, wherein the viscosity of the solution is reduced by at least 5, 6, 7, 8, 9 or 10 cP in a solution containing ≥100, 130, or 150 mg/ml of the trimeric XTEN preparation compared to a solution containing ≥100, 130, or 150 mg/ml of the corresponding linear XTEN of equal molar concentration. In another embodiment, the invention provides a composition comprising a solution that comprises a multimeric XTEN having at least five XTEN fragments linked together in a branched manner (e.g. pentameric manner) wherein the composition has a viscosity that is less than a solution comprising a corresponding linear XTEN having the same number of amino acids and the same molar concentration, wherein the viscosity of the solution is reduced by at least 5, 6, 7, 8, 9 or 10 cP in a solution containing ≥100, 130, or 150 mg/ml of the trimeric XTEN preparation compared to a solution containing ≥100, 130, or 150 mg/ml of the corresponding linear XTEN of equal molar concentration. In the foregoing embodiments of this paragraph, the individual XTEN of the multimeric configurations are selected from the group consisting of the sequences set forth in Table 2 and Table 3.

In another embodiment, the invention provides compositions of a polypeptide having at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from the group of sequences set forth in Table 52.

In another embodiment, the invention provides a pharmaceutical composition, comprising the conjugate of any one of the XTEN-payload conjugate embodiments described herein, and a pharmaceutically acceptable carrier. In one embodiment, the foregoing pharmaceutical composition has utility in the treatment of a condition selected from the group of conditions set forth in Table 16. In another embodiment, the foregoing pharmaceutical composition has utility for use in a pharmaceutical regimen for treatment of a subject, said regimen comprising the pharmaceutical composition. In another embodiment, the foregoing pharmaceutical regimen further comprises the step of determining the amount of pharmaceutical composition needed to achieve a beneficial effect in a subject having a condition selected from the group of conditions set forth in Table 16. In another embodiment, the foregoing pharmaceutical regimen used for treating the subject comprises administering the pharmaceutical composition in two or more successive doses to the subject at an effective amount, wherein the administration results in at least a 10%, or 20%, or 30%, or 40%, or 50%, or 60%, or 70%, or 80%, or 90% greater improvement of at least one, two, or three parameters associated with the condition compared to an untreated subject.

In another embodiment, the invention provides a conjugate of any one of the XTEN-payload conjugate embodiments described herein for use in the preparation of a medicament for treatment of a condition selected from the group of conditions set forth in Table 16.

In some embodiments, the invention provides methods of selecting a combination of payloads linked to XTEN as a therapeutic agent, the method comprising providing a library of XTENs comprising a plurality of XTEN sequences wherein each of said XTEN sequences is conjugated to at least a first payload and at least a second payload which is different from the first payload; from said library, selecting an XTEN sequence as the therapeutic agent if it exhibits an improved in vitro or in vivo parameter as compared to that of (1) an XTEN sequence conjugated to the first payload alone; and (2) an XTEN sequence conjugated to the second payload alone. In one embodiment of the method, the first payload and second payload are therapeutically effective for ameliorating a common disease (e.g. a disease to which both the first and second payload targets). In one embodiment of the method, the first drug and second drug are therapeutically effective for treating different symptoms of a common disease. In one embodiment of the method, the common disease is selected from cancer, cancer supportive care, cardiovascular, central nervous system, endocrine disease, gastrointestinal, genitourinary, hematological, HIV infection, hormonal disease, inflammation, autoimmune disease, infectious disease, metabolic disease, musculoskeletal disease, nephrology disorders, ophthalmologic diseases, pain, and respiratory. In one embodiment of the method, the first payload and second payload mediate their therapeutic effect via a common biological pathway. In one embodiment of the method, the first payload and second payload are different drugs selected from the group consisting of the drugs set forth in Table 11, Table 18 and Table 21. In one embodiment of the method, the first payload and second payload are different biologically active proteins selected from the group consisting of the proteins set forth in Table 12, Table 18 and Table 21. In one embodiment of the method, the first payload is a drug selected from the group consisting of the drugs set forth in Table 11, Table 18 and Table 21 and the second payload is a biologically active protein selected from the group consisting of the proteins set forth in Table 12, Table 18 and Table 21.

In another embodiment, the invention provides an isolated polypeptide comprising an extended recombinant polypeptide that is linked to an affinity purification tag via a proteolytic cleavage site having a sequence selected from SASRSA (SEQ ID NO: 21) or SASXSA (SEQ ID NO: 23) where X is R or K.

In another embodiment, the invention provides an isolated polypeptide comprising a polypeptide comprising an XTEN that is linked at its N-terminus to a first affinity purification tag via a proteolytic cleavage site having a sequence selected from SASRSA (SEQ ID NO: 21) or SASXSA (SEQ ID NO: 23) where X is R or K, and at its C-terminus to a second affinity purification tag via a proteolytic cleavage site having a sequence selected from SASRSA (SEQ ID NO: 21) or SASXSA (SEQ ID NO: 23) where X is R or K.

In another aspect, the invention relates to a method of treating a condition in a subject with an XTEN-payload conjugate composition. In one embodiment, the invention provides a method of treating a condition in a subject comprising administering an effective amount of the conjugate of any one of the XTEN-payload embodiments described herein to a subject in need thereof. In another embodiment, the invention provides a method of treating a condition in a subject comprising administering an effective amount of the conjugate of the group consisting of the conjugates set forth in Table 21 to a subject in need thereof. In the foregoing embodiments of this paragraph, the condition to be treated includes, but is not limited to, the conditions set forth in Table 13. In another embodiment, the invention provides a pharmaceutical composition comprising any of the XTEN-payload conjugate embodiments described herein and a pharmaceutically acceptable carrier for use in a treatment regimen, the regimen comprising administering two or more consecutive doses of the pharmaceutical composition.

In one embodiment, the invention provides the use of a conjugate of any one of the XTEN-payload embodiments described herein for the preparation of a medicament for treatment of a condition selected from the group of conditions set forth in Table 16. In another embodiment, the invention provides a pharmaceutical composition for treatment of a condition selected from the group of conditions set forth in Table 16. comprising an effective amount of a conjugate of any one of the XTEN-payload embodiments described herein.

In another embodiment, the invention provides a composition having the structure set forth in FIG. 117.

It is specifically contemplated that the conjugate embodiments can exhibit one or more or any combination of the properties disclosed herein. In addition, any of the XTEN compositions disclosed herein can be utilized in any of the methods disclosed herein.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The features and advantages of the invention may be further explained by reference to the following detailed description and accompanying drawings that sets forth illustrative embodiments.

FIG. 16 discloses SEQ ID NOS 1175-1176, respectively, in order of appearance.

FIG. 17 shows various XTEN-cross-linker precursor segments that are used as reactants to link to payloads or to other XTEN reactants. FIG. 17A is intended to show that the 1B represents the remaining reactive group of the precursors on the right. FIG. 17B shows similar reactive precursors with either multiple (left) or single (right) payload A molecules conjugated to the XTEN.

FIG. 19 is intended to show examples of various reactants and the nomenclature for configurations illustrated elsewhere in the Drawings. FIG. 19A shows various forms of reactive XTEN segment precursors, each with a different reactive group on the N-terminus. FIG. 19B shows various cross-linkers with 2, 3 or 4 reactive groups. In the first case, the divalent cross-linker is a heterofunctional linker that reacts with two different types of reactive groups, represented by "2" and "1". In the case of the trivalent and tetravalent cross-linker, each reacts with only one type of reactive group, represented by "1". FIG. 19C illustrates the nomenclature of the reaction products of two XTEN segment precursors. In the top version, a 1A was reacted with a 1B to create a dimeric XTEN linked at the N-termini, with the residue of the cross-linker indicated by $1A_R$-$1B_R$, while the bottom version is also a dimeric XTEN linked at the N-termini, with the residue of the cross-linker indicated by $2A_R$-$2B_R$.

FIG. 20A shows the steps of making an XTEN polypeptide, followed by reaction of the N-terminus with the cross-linker with 2B-1A reactive groups, with the 1A reacting with the N-terminal 1B (e.g., an alpha amino acid) to create the XTEN precursor 2 with the reactive group 2B. FIG. 20B shows the sequential addition of two cross-linkers with 2A reactive groups to 2B reactive groups of the XTEN, resulting in XTEN precursor 4, which is then reacted with a cross-linker at the N-terminus between a reactive 1B and the 1A of a cross-linker, resulting in XTEN precursor 5, with reactive groups 4B and 3B. In such case, the XTEN-precursors 5 then could serve as a reactant with two different payloads or XTEN.

FIG. 21A illustrates how three molecules of an XTEN with a conjugated payload A can be conjugated to a trimeric cross-linker, resulting in a trimeric XTEN-payload conjugate with three A payloads. FIG. 21B illustrates how three molecules of a polypeptide with an A payload can be conjugated to a trimeric cross-linker, resulting in a trimeric XTEN-payload conjugate with three polypeptides with A payloads.

FIG. 22A is an XTEN precursor with single thiol group. FIG. 22B is a divalent conjugate. FIG. 22C is a trimeric conjugate. FIG. 22D is a tetrameric conjugate.

FIG. 23A illustrates the thiol group located close to the C-terminus of XTEN. As a result the payload is located at the distal ends of the final trimeric conjugate. FIG. 23B illustrates that the thiol group is located close to the N-terminus of XTEN. As a result the payload is located at the proximal ends of the final conjugate resulting in increased payload shielding by XTEN.

FIG. 24A is a XTEN-payload precursor comprising linker reactive group 1A. The payload can be recombinantly fused to XTEN or it can be conjugated. FIG. 24B illustrates an XTEN-precursor with the comb-like cross-linkers. This can be an XTEN that carries a multiple reactive groups B.

FIG. 24C shows the final product in the "comb" configuration, with five Payload A. Valency is controlled by the number of reactive groups in the Comb-like precursor.

FIG. 25A illustrates configurations with one molecule each of two payloads, while FIG. 25B illustrates various configurations with multiple copies of one or both payloads.

FIG. 27A shows the creation of a single XTEN precursor to which two different payloads are attached. FIG. 27B shows a segment approach starting from two XTEN precursor molecules. This approach allows one to conjugate both payloads to XTEN using the same type of linker chemistry. In this case, the figure shows thiol as the group to which payloads are conjugated, and then the N-terminus of each segment is modified with a cross-linker to enable head-to-head segment conjugation, resulting in a dimeric, bispecific conjugate final product.

FIG. 28A illustrates two XTENs conjugated to IgG at Cys residues in the hinge region. FIG. 28B illustrates four XTEN conjugated to IgG using Cys in the hinge region. FIG. 28C illustrates XTEN conjugated outside of hinge. This can be done by inserting Cys to control conjugation site or by random conjugation to Lys side chains.

FIG. 30A shows 1×(1×3) conjugate. FIG. 30B shows 1×2(1×3) conjugate. FIG. 30C shows a 3×1(1×3) conjugate.

FIG. 41 shows generalized XTEN with either N- or C-terminal tags or N- and C-terminal sequences optimized for purification using methods illustrated in FIG. 42.

FIG. 48 shows a non-reducing 4-12% Bis-Tris SDS-PAGE analysis of Toyopearl IMAC Chromatography flow through, wash (FIG. 48A) and elution fractions (FIG. 48B) (non-reducing) as described in Example 18.

FIG. 49 discloses "H8" as SEQ ID NO: 20.

FIG. 51A, flow-through, Coomassie staining. FIG. 51B, elution fractions, Coomassie staining. FIG. 51C, elution fractions, silver staining.

FIG. 60 discloses "H8" as SEQ ID NO: 20.

FIG. 63 shows an SDS-PAGE analysis of the trypsin digestion of RP11-XTEN-His8 ("His8" disclosed as SEQ ID NO: 20) protein purified by two chromatographic steps (SP+IMAC) described in Example 21. Preparations were analyzed by 4-12% SDS-PAGE followed by Coomassie staining (FIG. 63A) and silver staining (FIG. 63B).

FIG. 64A shows the C18 RP-HPLC analysis of the reaction mixture. A 20 μg protein sample was loaded on a Phenomenex Jupiter C18 5 uM 300 A 4.6 mm×150 mm column. The proteins were eluted with a 5-50% gradient of acetonitrile in 0.1% trifluoroacetic acid. FIG. 64B shows the HIC purification of DBCO-XTEN reaction product. FIG. 64C shows the C18 RP-HPLC analysis of the HIC-purified DBCO-XTEN reaction product.

FIG. 65 shows results from trypsin cleavage of a double tagged precursor XTEN, as described in Example 24.

FIG. 66 shows results of an SDS-PAGE analysis of MacroCap Q purification of trypsin digested double tagged precursor, as described in Example 24.

FIG. 67A is the trace output of analysis of synthetic [G2]GLP2 peptide in intact form. FIG. 67B is the trace output of analysis of synthetic [G2]GLP2 peptide digested with bovine trypsin. FIG. 67C is the trace output of analysis of XTEN_AE869_Am1,C2 spiked with [G2]GLP2 and incubated overnight at 37° C., as described in Example 24.

FIG. 68A: initial 1×Amino-XTEN protein. FIG. 68B: product of the reaction between 1×Amino-XTEN and sulfo-SMCC cross-linker. FIG. 68C: purified GLP2-XTEN conjugate after reaction between GLP2-Cys and N-Mal-XTEN.

FIG. 69A: initial 1×Thiol-XTEN protein. FIG. 69B: product of the reaction between GLP2-Mal and 1×Thiol-XTEN.

FIG. 70 shows the results of the purification of GLP2-XTEN using preparative C4 RP-HPLC as described in Example 27. FIG. 70A shows a chromatography profile of preparative RP-HPLC. A fraction at 56-62 min was collected and evaporated under vacuum. FIG. 70B shows an analysis by C18 RP-HPLC for purified GLP2-XTEN.

FIG. 71A shows C18 RP-HPLC analysis of the reaction mixture. A 20 μg protein sample was loaded on Phenomenex Jupiter C18 5 uM 300 A 4.6 mm×150 mm column. Proteins were eluted with a 5-50% gradient of acetonitrile in 0.1% trifluoroacetic acid. FIG. 71B shows the HIC purification of DBCO-XTEN. FIG. 71C shows the C18 RP-HPLC analysis of the HIC-purified DBCO-XTEN.

FIG. 72 shows results of analytical assays of XTEN conjugated with cross-linked FITC, as described in Example 31. FIG. 72A shows the co-migration in a gel imaged by UV light box to show the large apparent MW of FITC-containing conjugated species, also detected by SEC at OD214 (protein signal) and OD495 (FITC signal) in a SEC column, indicating successful labeling of the XTEN with minimal free dye contamination. The materials by lane (left to right, after the MW standards are: labeled FITC-CL-CBD-XTEN; labeled FITC-CL-XTEN; purified FITC-CL-XTEN; purified FITC-CL-XTEN; and purified FITC-CL-XTEN. The gel was imaged by UV light box to show FITC apparent MW of FITC containing species. FIG. 72B shows the results of SEC analysis of FITC-conjugated XTEN, showing the overlap of the output of materials detected at OD214 and OD495, and also the apparent large molecular weight.

FIG. 80 depicts the application of the algorithm SegScore to a hypothetical XTEN of 11 amino acids in order to determine the repetitiveness. An XTEN sequence (SEQ ID NO: 1177) consisting of N amino acids is divided into N−S+1 subsequences of length S (S=3 in this case). A pair-wise comparison of all subsequences is performed and the average number of identical subsequences is calculated to result, in this case, in a subsequence score of 1.89.

FIG. 82 shows the screening results of libraries LCW1157-1159. FIG. 82A-C provides the fluorescence histograms of LCW1157-1159, showing the number of colonies identified for each fluorescence signal region, as described in Example 12. The average fluorescence reading of the negative control (black arrow) and positive pSD0116 (white arrow) are marked in the figures. FIG. 82D-F provides the correlation between the fluorescence reading in the original test and the retest of the select clones.

FIG. 87A: Batch 2, lane 1: molecular weight standard; lanes 2-5: MacroCap Q flow through fractions 1-4, respectively; lanes 6-16: MacroCap Q elution fractions 1-11, respectively. FIG. 87B: Batch 1, lane 1: molecular weight standard; lanes 2-6: MacroCap Q flow through fractions 1-5, respectively; lanes 7-16: MacroCap Q elution fractions 1-10, respectively.

FIG. 89A is analysis of the initial 1×Amino,3×Thiol-XTEN reactant. FIG. 89B is analysis of the protein modification with MMAE-Maleimide, showing the mass increase corresponding to modifications of three cysteines with MMAE-Mal. FIG. 89C shows the analysis of the protein modification with Azide-PEG4-NHS ester, with mass increases corresponding to the single addition of the azide-PEG4 moiety.

FIG. 90A: SDS-PAGE analysis of the click conjugate. 0.5 μg of proteins were loaded per lane on 12% Bis-Tris NuPAGE mini gel (Life Technologies). The gel was stained with Pierce Silver Stain Kit (Thermo Scientific, cat. #24612). Lane 1, 1×Azide,3×MMAE-XTEN; lane 2, 1×DBCO,3×LHRH-XTEN; lane 3, products of click chemistry reaction. The conjugation product band is indicated by the arrow. FIG. 90B: C4 RP-HPLC analysis of the click conjugate reactants and products—(1) 1×DBCO,3×LHRH-XTEN; (2) 1×Azide,3×MMAE-XTEN; (3) products of click chemistry reaction.

FIG. 91A: initial 1×Amino,3×Thiol-XTEN; FIG. 91B: protein modification with 2,2'-Dipyridyl disulfide; FIG. 91C: protein modification with DBCO-sulfo-NHS; FIG. 91D: deprotection of cysteines with TCEP; FIG. 91E: Modification of three cysteines with MMAE-Mal; FIG. 91F: Conjugation of LHRH-azide to N-terminal DBCO.

FIG. 92A: Initial 1×Amino,3×Thiol-XTEN; FIG. 92B: Protein modification with PTX-Mal; FIG. 92C: Protein modification with Sulfo-SMCC.

FIG. 93A: 1×Amino-XTEN analyzed by C18-RP-HPLC before and after incubation with 10× excess of SIA. FIG. 93B: ESI-MS analysis of 1×Amino-XTEN modified with SIA. FIG. 93C: Samples analyzed by C18 RP-HPLC-Bottom profile—HCKFWW (SEQ ID NO: 25) peptide. Medium profile—IA-XTEN. Upper profile—reaction of IA-XTEN with 5× excess of HCKFWW (SEQ ID NO: 25) peptide.

FIG. 94A-D: Fluorescence histogram of LCW1171, 1172, 1203, 1204, showing the number of colonies identified for each fluorescence signal region; average fluorescence reading of negative control (black arrow) and pSD0116 (white arrow) when screening LCW1171-1172 were marked in the FIGS. 94A and B; average fluorescence reading of negative control (black arrow), pSD0116 (white arrow), and CBD control (grey arrow) when screening LCW1203-1204 are marked in FIGS. 94C and D.

FIGS. 95A-C: Fluorescence histograms of LCW1208-1210, showing the number of colonies identified for each fluorescence signal region; average fluorescence reading of negative control (black arrow) and CBD control (grey arrow) are marked in the figures.

FIG. 96 illustrated the production of XTEN segments from a precursor that contains three repeat copies of XTEN of identical length and sequence. In FIG. 96A, the XTEN precursor comprises three identical copies of XTEN that are flanked by identical protease cleavage sites. In FIG. 96B, the XTEN precursor further comprises N- and C-terminal affinity purification tags to facilitate purification of full-length precursor molecules. Following purification of the precursor it is cleaved by protease that acts on all the incorporated cleavage sequences to release the tags from the XTEN, which is followed by purification to separate the individual units of XTEN, facilitating the high-yield production of XTENs with short and intermediate lengths from long-chain precursor molecules.

FIGS. 97A and B illustrates conjugates having a single payload molecule, with FIG. 97A using a 4-arm cross-linker with all the XTEN conjugated in close proximity to the payload, resulting in significant shielding of payload interactions with other molecules. FIG. 97B illustrates a configuration in where the payload is conjugated to a single XTEN arm that is branched at the distal end of the configuration, resulting in reduced payload shielding compared to the configuration of FIG. 97A. FIG. 97C illustrates a conjugate with two payloads that can result in increased avidity or increased potency. FIGS. 97D and E illustrates configurations with three identical payloads to further increase potency and/or avidity. FIG. 97F illustrates a configuration with one payload A and two identical copies of payload B for high-avidity binding or interactions. FIG. 97G illustrates a configuration with 3 different payloads enabling the inclusion of three different functions into a single XTEN conjugate.

FIG. 107A is analysis of the initial 1×Amino,3×Thiol-XTEN reactant FIG. 107B is analysis of the protein modification with Folate-gamma-Maleimide, showing the mass increase corresponding to modifications of three cysteines with FA(γ)-Mal. FIG. 107C shows the analysis of the protein modification with DBCO-sulfo-NHS ester, with mass increases corresponding to the single addition of the DBCO moiety.

FIG. 109A shows size exclusion chromatography analysis (Phenomenex BioSep-SEC-s4000 600×7.80 mm column, 50 mM Sodium Phosphate pH 6.5, 300 mM NaCl buffer, flow rate 0.5 ml/min, isocratic elution 70 min). FIG. 109B shows RP-HPLC analysis (Phenomenex Jupiter C18 5 µM 300 Å 150×4.60 mm column, Buffer A: 0.1% TFA in H2O, Buffer B: 0.1% TFA in CAN, flow rate 1 ml/min, gradient 5% to 50% B in 45 min). FIG. 3C shows ESI-MS analysis (QSTAR-XL, calculated MW 85,085.4 Da, experimental MW 85,091 Da).

FIG. 113A shows the SEC-HPLC analysis of the reaction products between Tris-[2-maleimidoethyl]amine and 1×Amino,1×Thiol-XTEN432: FIG. 113A—conjugation mixture: peak 1—trimeric XTEN, peak 2—dimeric XTEN, peak 3—unreacted monomeric XTEN; FIG. 113B—linear XTEN_1296 control; FIG. 113C—linear XTEN_864 control; FIG. 113D—linear XTEN_432 control.

FIG. 114A shows the C18 RP-HPLC analysis of DBCO-sulfo-NHS conjugation to 1×Amino-XTEN_288, as described in Example 65. Unreacted XTEN eluted at 19 min. 1×DBCO-XTEN_288 eluted at 27 min. DBCO-sulfo-NHS reagent and product of its hydrolysis eluted at 41.5 min and 38.5 min, respectively. FIG. 114B shows C18 RP-HPLC analysis of Azido-PEG4-NHS ester conjugation to Tris(2-aminoethyl)amine. 3×Azide-PEG4-TAEA was identified by MALDI-TOF MS and ESI-MS as a product with MW of 966 Da.

Figure 117A:
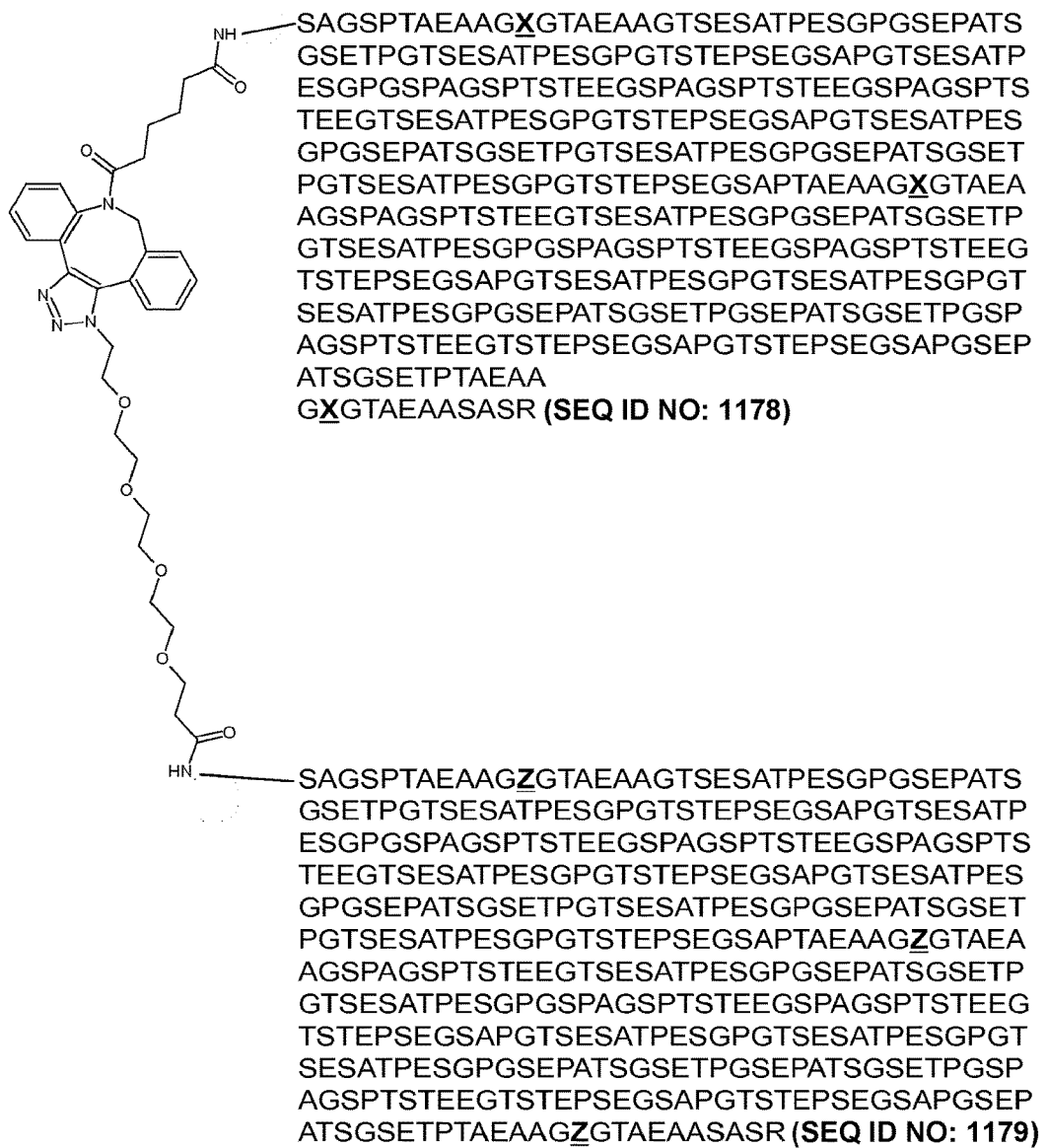

FIG. 117 shows the structure of the XTEN-payload conjugate 3×FA(γ),3×MMAE-XTEN. FIG. 117A shows the two XTEN (SEQ ID NOS 1178-1179, respectively, in order of appearance) linked by the reaction of the azide 1-azido-3,6,9,12-tetraoxapentadecan-15-oic acid, N-hydroxysuccinimide ester and the alkyne 6-(11,12-didehydrodibenzo[b,f]azocin-5(6H)-yl)-6-oxohexanoic acid, N-hydroxysuccinimide (or N-hydroxysulfosuccinimide) ester. FIG. 117B shows the X residue of Cys modified with folate-γ-aminopentyl-maleimide. FIG. 117C shows the Z residue of Cys modified with maleimidocaproyl-valine-citrulline-p-aminobenzyloxycarbonyl-monomethylauristatin E.

DETAILED DESCRIPTION OF THE INVENTION

Before the embodiments of the invention are described, it is to be understood that such embodiments are provided by way of example only, and that various alternatives to the embodiments of the invention described herein may be employed in practicing the invention. Numerous variations, changes, and substitutions will now occur to those skilled in the art without departing from the invention.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

In the context of the present application, the following terms have the meanings ascribed to them unless specified otherwise:

As used throughout the specification and claims, the terms "a", "an" and "the" are used in the sense that they mean "at least one", "at least a first", "one or more" or "a plurality" of the referenced components or steps, except in instances wherein an upper limit is thereafter specifically stated. Therefore, a "payload", as used herein, means "at least a first payload" but includes a plurality of payloads. The operable limits and parameters of combinations, as with the amounts of any single agent, will be known to those of ordinary skill in the art in light of the present disclosure.

The terms "polypeptide", "peptide", and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified, for example, by disulfide bond formation, glycosylation, lipidation, acetylation, phosphorylation, or any other manipulation, such as conjugation with a labeling component.

As used herein, the term "amino acid" refers to either natural and/or unnatural or synthetic amino acids, including but not limited to both the D or L optical isomers, and amino acid analogs and peptidomimetics. Standard single or three letter codes are used to designate amino acids.

A "pharmacologically active" agent includes any drug, compound, composition of matter or mixture desired to be delivered to a subject, e.g. therapeutic agents, diagnostic agents, or drug delivery agents, which provides or is expected to provide some pharmacologic, often beneficial, effect that can be demonstrated in vivo or in vitro. Such agents may include peptides, proteins, carbohydrates, nucleic acids, nucleosides, oligonucleotides, and small molecule synthetic compounds, or analogs thereof.

The term "natural L-amino acid" means the L optical isomer forms of glycine (G), proline (P), alanine (A), valine (V), leucine (L), isoleucine (I), methionine (M), cysteine (C), phenylalanine (F), tyrosine (Y), tryptophan (W), histidine (H), lysine (K), arginine (R), glutamine (Q), asparagine (N), glutamic acid (E), aspartic acid (D), serine (S), and threonine (T).

The term "non-naturally occurring," as applied to sequences and as used herein, means polypeptide or polynucleotide sequences that do not have a counterpart to, are not complementary to, or do not have a high degree of homology with a wild-type or naturally-occurring sequence found in a mammal. For example, a non-naturally occurring polypeptide or fragment may share no more than 99%, 98%, 95%, 90%, 80%, 70%, 60%, 50% or even less amino acid sequence identity as compared to a natural sequence when suitably aligned.

The terms "hydrophilic" and "hydrophobic" refer to the degree of affinity that a substance has with water. A hydrophilic substance has a strong affinity for water, tending to dissolve in, mix with, or be wetted by water, while a hydrophobic substance substantially lacks affinity for water, tending to repel and not absorb water and tending not to dissolve in or mix with or be wetted by water. Amino acids can be characterized based on their hydrophobicity. A number of scales have been developed. An example is a scale developed by Levitt, M, et al., J Mol Biol (1976) 104:59, which is listed in Hopp, T P, et al., Proc Natl Acad Sci USA (1981) 78:3824. Examples of "hydrophilic amino acids" are arginine, lysine, threonine, alanine, asparagine, and glutamine. Of particular interest are the hydrophilic amino acids aspartate, glutamate, and serine, and glycine. Examples of "hydrophobic amino acids" are tryptophan, tyrosine, phenylalanine, methionine, leucine, isoleucine, and valine.

A "fragment" when applied to a biologically active protein, is a truncated form of a the biologically active protein that retains at least a portion of the therapeutic and/or biological activity. A "variant," when applied to a biologically active protein is a protein with sequence homology to the native biologically active protein that retains at least a portion of the therapeutic and/or biological activity of the biologically active protein. For example, a variant protein may share at least 70%, 75%, 80%, 85%, 90%, 95%, 96%, 97%, 98% or 99% amino acid sequence identity compared with the reference biologically active protein. As used herein, the term "biologically active protein variant" includes proteins modified deliberately, as for example, by site directed mutagenesis, synthesis of the encoding gene, insertions, or accidentally through mutations and that retain activity.

The term "sequence variant" means polypeptides that have been modified compared to their native or original sequence by one or more amino acid insertions, deletions, or substitutions. Insertions may be located at either or both termini of the protein, and/or may be positioned within internal regions of the amino acid sequence. A non-limiting example is insertion of an XTEN sequence within the sequence of the biologically-active payload protein. Another non-limiting example is substitution of an amino acid in an XTEN with a different amino acid. In deletion variants, one or more amino acid residues in a polypeptide as described herein are removed. Deletion variants, therefore, include all fragments of a payload polypeptide sequence. In substitution variants, one or more amino acid residues of a polypeptide are removed and replaced with alternative residues. In one aspect, the substitutions are conservative in nature and conservative substitutions of this type are well known in the art.

The term "moiety" means a component of a larger composition or that is intended to be incorporated into a larger composition, such as a functional group of a drug molecule or a targeting peptide joined to a larger polypeptide.

As used herein, "terminal XTEN" refers to XTEN sequences that have been fused to or in the N- or C-terminus of the payload when the payload is a peptide or polypeptide.

The term "XTEN release site" refers to a cleavage sequence in XTEN-payload that can be recognized and cleaved by a protease, effecting release of an XTEN or a portion of an XTEN from the XTEN-payload polypeptide. As used herein, "mammalian protease" means a protease that normally exists in the body fluids, cells or tissues of a mammal. XTEN release sites can be engineered to be cleaved by various mammalian proteases (a.k.a. "XTEN release proteases") such as trypsin, FXIa, FXIIa, kallikrein, FVIIIa, FVIIIa, FXa, FIIa (thrombin), Elastase-2, MMP-12, MMP13, MMP-17, MMP-20, or any protease that is present in a subject. Other equivalent proteases (endogenous or exogenous) that are capable of recognizing a defined cleavage site can be utilized. The cleavage sites can be adjusted and tailored to the protease utilized.

The term "within", when referring to a first polypeptide being linked to a second polypeptide, encompasses linking that connects the N-terminus of the first or second polypeptide to the C-terminus of the second or first polypeptide, respectively, as well as insertion of the first polypeptide into the sequence of the second polypeptide. For example, when an XTEN is linked "within" a payload polypeptide, the XTEN may be linked to the N-terminus, the C-terminus, or may be inserted between any two amino acids of the payload polypeptide.

"Activity" as applied to form(s) of a XTEN-payload composition provided herein, refers to an action or effect, including but not limited to receptor binding, antagonist activity, agonist activity, a cellular or physiologic response, or an effect generally known in the art for the payload, whether measured by an in vitro, ex vivo or in vivo assay or a clinical effect.

As used herein, the term "ELISA" refers to an enzyme-linked immunosorbent assay as described herein or as otherwise known in the art.

A "host cell" includes an individual cell or cell culture which can be or has been a recipient for the subject vectors such as those described herein. Host cells include progeny of a single host cell. The progeny may not necessarily be completely identical (in morphology or in genomic of total DNA complement) to the original parent cell due to natural, accidental, or deliberate mutation. A host cell includes cells transfected in vivo with a vector of this invention.

"Isolated" when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. As is apparent to those of skill in the art, a non-naturally occurring polynucleotide, peptide, polypeptide, protein, antibody, or fragments thereof, does not require "isolation" to distinguish it from its naturally occurring counterpart. In addition, a "concentrated", "separated" or "diluted" polynucleotide, peptide, polypeptide, protein, antibody, or fragments thereof, is distinguishable from its naturally occurring counterpart in that the concentration or number of molecules per volume is generally greater than that of its naturally occurring counterpart. In general, a polypeptide made by recombinant means and expressed in a host cell is considered to be "isolated."

An "isolated" nucleic acid is a nucleic acid molecule that is identified and separated from at least one contaminant nucleic acid molecule with which it is ordinarily associated in the natural source of the polypeptide-encoding nucleic acid. For example, an isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal or extra-chromosomal location different from that of natural cells.

A "chimeric" protein contains at least one fusion polypeptide comprising at least one region in a different position in the sequence than that which occurs in nature. The regions may normally exist in separate proteins and are brought together in the fusion polypeptide; or they may normally exist in the same protein but are placed in a new arrangement in the fusion polypeptide. A chimeric protein may be created, for example, by chemical synthesis, or by creating and translating a polynucleotide in which the peptide regions are encoded in the desired relationship.

"Fused," and "fusion" are used interchangeably herein, and refers to the joining together of two or more peptide or polypeptide sequences by recombinant means.

"Operably linked" means that the DNA sequences being linked are contiguous, and in reading phase or in-frame. An "in-frame fusion" refers to the joining of two or more open reading frames (ORFs) to form a continuous longer ORF, in a manner that maintains the correct reading frame of the original ORFs. For example, a promoter or enhancer is operably linked to a coding sequence for a polypeptide if it affects the transcription of the polypeptide sequence. Thus, the resulting recombinant fusion protein is a single protein containing two or more segments that correspond to polypeptides encoded by the original ORFs (which segments are not normally so joined in nature).

"Crosslinking," "conjugating," "link," "linking" and "joined to" are used interchangeably herein, and refer to the covalent joining of two different molecules by a chemical reaction. The crosslinking can occur in one or more chemical reactions, as described more fully, below.

The term "conjugation partner" as used herein, refers to the individual components that can be linked or are linked in a conjugation reaction.

The term "conjugate" is intended to refer to the heterogeneous molecule formed as a result of covalent linking of conjugation partners one to another, e.g., a biologically active payload covalently linked to a XTEN molecule or a cross-linker covalently linked to a reactive XTEN.

"Cross-linker" and "linker" and "cross-linking agent" are used interchangably and in their broadest context to mean a chemical entity used to covalently join two or more entities. For example, a cross-linker joins two, three, four or more XTEN, or joins a payload to an XTEN, as the entities are defined herein. A cross-linker includes, but is not limited to, the reaction product of small molecule zero-length, homo- or hetero-bifunctional, and multifunctional cross-linker compounds, the reaction product of two click-chemistry reactants. It will be understood by one of skill in the art that a cross-linker can refer to the covalently-bound reaction product remaining after the crosslinking of the reactants. The cross-linker can also comprise one or more reactants which have not yet reacted but which are capable to react with another entity.

In the context of polypeptides, a "linear sequence" or a "sequence" is an order of amino acids in a polypeptide in an amino to carboxyl terminus direction in which residues that neighbor each other in the sequence are contiguous in the primary structure of the polypeptide. A "partial sequence" is a linear sequence of part of a polypeptide that is known to comprise additional residues in one or both directions.

"Heterologous" means derived from a genotypically distinct entity from the rest of the entity to which it is being compared. For example, a glycine rich sequence removed from its native coding sequence and operatively linked to a coding sequence other than the native sequence is a heterologous glycine rich sequence. The term "heterologous" as applied to a polynucleotide, a polypeptide, means that the polynucleotide or polypeptide is derived from a genotypically distinct entity from that of the rest of the entity to which it is being compared.

The terms "polynucleotides", "nucleic acids", "nucleotides" and "oligonucleotides" are used interchangeably. They refer to a polymeric form of nucleotides of any length, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

The term "complement of a polynucleotide" denotes a polynucleotide molecule having a complementary base sequence and reverse orientation as compared to a reference sequence, such that it could hybridize with a reference sequence with complete fidelity.

"Recombinant" as applied to a polynucleotide means that the polynucleotide is the product of various combinations of recombination steps which may include cloning, restriction and/or ligation steps, and other procedures that result in expression of a recombinant protein in a host cell.

The terms "gene" and "gene fragment" are used interchangeably herein. They refer to a polynucleotide containing at least one open reading frame that is capable of encoding a particular protein after being transcribed and translated. A gene or gene fragment may be genomic or cDNA, as long as the polynucleotide contains at least one open reading frame, which may cover the entire coding region or a segment thereof. A "fusion gene" is a gene composed of at least two heterologous polynucleotides that are linked together.

"Homology" or "homologous" or "sequence identity" refers to sequence similarity or interchangeability between two or more polynucleotide sequences or between two or more polypeptide sequences. When using a program such as BestFit to determine sequence identity, similarity or homology between two different amino acid sequences, the default settings may be used, or an appropriate scoring matrix, such as blosum45 or blosum80, may be selected to optimize identity, similarity or homology scores. Preferably, polynucleotides that are homologous are those which hybridize under stringent conditions as defined herein and have at least 70%, preferably at least 80%, more preferably at least 90%, more preferably 95%, more preferably 97%, more preferably 98%, and even more preferably 99% sequence identity compared to those sequences. Polypeptides that are homologous preferably have sequence identities that are at least 70%, preferably at least 80%, even more preferably at least 90%, even more preferably at least 95-99% identical.

"Ligation" as applied to polynucleic acids refers to the process of forming phosphodiester bonds between two nucleic acid fragments or genes, linking them together. To ligate the DNA fragments or genes together, the ends of the DNA must be compatible with each other. In some cases, the ends will be directly compatible after endonuclease digestion. However, it may be necessary to first convert the staggered ends commonly produced after endonuclease digestion to blunt ends to make them compatible for ligation.

The terms "stringent conditions" or "stringent hybridization conditions" includes reference to conditions under which a polynucleotide will hybridize to its target sequence, to a detectably greater degree than other sequences (e.g., at least 2-fold over background). Generally, stringency of hybridization is expressed, in part, with reference to the temperature and salt concentration under which the wash step is carried out. Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short polynucleotides (e.g., 10 to 50 nucleotides) and at least about 60° C. for long polynucleotides (e.g., greater than 50 nucleotides)—for example, "stringent conditions" can include hybridization in 50% formamide, 1 M NaCl, 1% SDS at 37° C., and three washes for 15 min each in 0.1×SSC/1% SDS at 60° C. to 65° C. Alternatively, temperatures of about 65° C., 60° C., 55° C., or 42° C. may be used. SSC concentration may be varied from about 0.1 to 2×SSC, with SDS being present at about 0.1%. Such wash temperatures are typically selected to be about 5° C. to 20° C. lower than the thermal melting point for the specific sequence at a defined ionic strength and pH. The Tm is the temperature (under defined ionic strength and pH) at which 50% of the target sequence hybridizes to a perfectly matched probe. An equation for calculating Tm and conditions for nucleic acid hybridization are well known and can be found in Sambrook, J. et al., "Molecular Cloning: A Laboratory Manual," 3$^{rd}$ edition, Cold Spring Harbor Laboratory Press, 2001. Typically, blocking reagents are used to block non-specific hybridization. Such blocking reagents include, for instance, sheared and denatured salmon sperm DNA at about 100-200 µg/ml. Organic solvent, such as formamide at a concentration of about 35-50% v/v, may also be used under particular circumstances, such as for RNA:DNA hybridizations. Useful variations on these wash conditions will be readily apparent to those of ordinary skill in the art.

The terms "percent identity," percentage of sequence identity," and "% identity," as applied to polynucleotide sequences, refer to the percentage of residue matches between at least two polynucleotide sequences aligned using a standardized algorithm. Such an algorithm may insert, in a standardized and reproducible way, gaps in the sequences being compared in order to optimize alignment between two sequences, and therefore achieve a more meaningful comparison of the two sequences. Percent identity may be measured over the length of an entire defined polynucleotide sequence, or may be measured over a shorter length, for example, over the length of a fragment taken from a larger, defined polynucleotide sequence, for instance, a fragment of at least 45, at least 60, at least 90, at least 120, at least 150, at least 210 or at least 450 contiguous residues. Such lengths are exemplary only, and it is understood that any fragment length supported by the sequences shown herein, in the tables, figures or Sequence Listing, may be used to describe a length over which percentage identity may be measured. The percentage of sequence identity is calculated by comparing two optimally aligned sequences over the window of comparison, determining the number of matched positions (at which identical residues occur in both polypeptide sequences), dividing the number of matched positions by the total number of positions in the window of comparison (i.e., the window size), and multiplying the result by 100 to yield the percentage of sequence identity. When sequences of different length are to be compared, the shortest sequence defines the length of the window of comparison. Conservative substitutions are not considered when calculating sequence identity.

"Percent (%) sequence identity," with respect to the polypeptide sequences identified herein, is defined as the percentage of amino acid residues in a query sequence that are identical with the amino acid residues of a second, reference polypeptide sequence or a portion thereof, after aligning the sequences and introducing gaps, if necessary, to achieve the maximum percent sequence identity, and not considering any conservative substitutions as part of the sequence identity, thereby resulting in optimal alignment. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve optimal alignment over the full length of the sequences being compared. Percent identity may be measured over the length of an entire defined polypeptide sequence, or may be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, may be used to describe a length over which percentage identity may be measured.

"Repetitiveness" used in the context of polynucleotide sequences refers to the degree of internal homology in the sequence such as, for example, the frequency of identical nucleotide sequences of a given length. Repetitiveness can, for example, be measured by analyzing the frequency of identical sequences.

A "vector" is a nucleic acid molecule, preferably self-replicating in an appropriate host, which transfers an inserted nucleic acid molecule into and/or between host cells. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be transcribed and translated into a polypeptide(s). An "expression system" usually connotes a suitable host cell comprised of an expression vector that can function to yield a desired expression product.

"Serum degradation resistance," as applied to a polypeptide, refers to the ability of the polypeptides to withstand degradation in blood or components thereof, which typically involves proteases in the serum or plasma. The serum degradation resistance can be measured by combining the protein with human (or mouse, rat, monkey, as appropriate) serum or plasma, typically for a range of days (e.g. 0.25, 0.5, 1, 2, 4, 8, 16 days), typically at about 37° C. The samples for these time points can be run on a Western blot assay and the protein is detected with an antibody. The antibody can be to a tag in the protein. If the protein shows a single band on the western, where the protein's size is identical to that of the injected protein, then no degradation has occurred. In this exemplary method, the time point where 50% of the protein is degraded, as judged by Western blots or equivalent techniques, is the serum degradation half-life or "serum half-life" of the protein.

The terms "$t_{1/2}$", "half-life", "terminal half-life", "elimination half-life" and "circulating half-life" are used interchangeably herein and, as used herein means the terminal half-life calculated as $\ln(2)/K_{el}$. $K_{el}$ is the terminal elimination rate constant calculated by linear regression of the terminal linear portion of the log concentration vs. time curve. Half-life typically refers to the time required for half the quantity of an administered substance deposited in a living organism to be metabolized or eliminated by normal biological processes.

"Active clearance" means the mechanisms by which a protein is removed from the circulation other than by filtration, and which includes removal from the circulation mediated by cells, receptors, metabolism, or degradation of the protein.

"Apparent molecular weight factor" and "apparent molecular weight" are related terms referring to a measure of the relative increase or decrease in apparent molecular weight exhibited by a particular amino acid or polypeptide sequence. The apparent molecular weight is determined using size exclusion chromatography (SEC) or similar methods by comparing to globular protein standards, and is measured in "apparent kD" units. The apparent molecular weight factor is the ratio between the apparent molecular weight and the actual molecular weight; the latter predicted by adding, based on amino acid composition, the calculated molecular weight of each type of amino acid in the composition or by estimation from comparison to molecular weight standards in an SDS electrophoresis gel. Determination of both the apparent molecular weight and apparent molecular weight factor for representative proteins is described in the Examples.

The terms "hydrodynamic radius" or "Stokes radius" is the effective radius ($R_h$, in nm) of a molecule in a solution measured by assuming that it is a body moving through the solution and resisted by the solution's viscosity. In the embodiments of the invention, the hydrodynamic radius measurements of the XTEN polypeptides correlate with the "apparent molecular weight factor" which is a more intuitive measure. The "hydrodynamic radius" of a protein affects its rate of diffusion in aqueous solution as well as its ability to migrate in gels of macromolecules. The hydrodynamic radius of a protein is determined by its molecular weight as well as by its structure, including shape and compactness. Methods for determining the hydrodynamic radius are well known in the art, such as by the use of size exclusion chromatography (SEC), as described in U.S. Pat. Nos. 6,406,632 and 7,294,513. Most proteins have globular structure, which is the most compact three-dimensional structure a protein can have with the smallest hydrodynamic radius. Some proteins adopt a random and open, unstructured, or 'linear' conformation and as a result have a much larger hydrodynamic radius compared to typical globular proteins of similar molecular weight.

"Physiological conditions" refers to a set of conditions in a living host as well as in vitro conditions, including temperature, salt concentration, pH, that mimic those conditions of a living subject. A host of physiologically relevant conditions for use in in vitro assays have been established. Generally, a physiological buffer contains a physiological concentration of salt and is adjusted to a neutral pH ranging from about 6.5 to about 7.8, and preferably from about 7.0 to about 7.5. A variety of physiological buffers are listed in Sambrook et al. (2001). Physiologically relevant temperature ranges from about 25° C. to about 38° C., and preferably from about 35° C. to about 37° C.

A "single atom residue of a payload" means the atom of a payload that is chemically linked to XTEN after reaction with the subject XTEN or XTEN-linker compositions; typically a sulfur, an oxygen, a nitrogen, or a carbon atom. For example, an atom residue of a payload could be a sulfur residue of a cysteine thiol reactive group in a payload, a nitrogen molecule of an amino reactive group of a peptide or polypeptide or small molecule payload, a carbon or oxygen residue or a reactive carboxyl or aldehyde group of a peptide, protein or a small molecule or synthetic, organic drug.

A "reactive group" is a chemical structure that can be coupled to a second reactive group. Examples of reactive groups are amino groups, carboxyl groups, sulfhydryl groups, hydroxyl groups, aldehyde groups, azide groups. Some reactive groups can be activated to facilitate conjugation with a second reactive group, either directly or through a cross-linker. As used herein, a reactive group can be a part of an XTEN, a cross-linker, an azide/alkyne click-chemistry reactant, or a payload so long as it has the ability to participate in a chemical reaction. Once reacted, a conjugation bond links the residues of the payload or cross-linker or XTEN reactants.

"Controlled release agent", "slow release agent", "depot formulation" and "sustained release agent" are used interchangeably to refer to an agent capable of extending the duration of release of a polypeptide of the invention relative to the duration of release when the polypeptide is administered in the absence of agent. Different embodiments of the present invention may have different release rates, resulting in different therapeutic amounts.

The term "payload" as used herein refers to any protein, peptide sequence, small molecule, drug or composition of matter that has a biological, pharmacological or therapeutic activity or beneficial effect when administered in a subject or that can be demonstrated in vitro. Payload also includes a molecule that can be used for imaging or in vivo diagnostic purposes. Examples of payloads include, but are not limited to, cytokines, enzymes, hormones, blood coagulation factors, and growth factors, chemotherapeutic agents, antiviral compounds, toxins, anti-cancer drugs, radioactive compounds, and contrast agents, as well as targeting peptides, proteins, antibodies, antibody fragments, or compounds used to bind to receptors or ligands.

The terms "antigen", "target antigen" and "immunogen" are used interchangeably herein to refer to the structure or binding determinant that an antibody fragment or an antibody fragment-based therapeutic binds to or has specificity against.

The term "antagonist", as used herein, includes any molecule that partially or fully blocks, inhibits, or neutralizes a biological activity of a native polypeptide disclosed herein. Methods for identifying antagonists of a polypeptide may comprise contacting a native polypeptide with a candidate antagonist molecule and measuring a detectable change in one or more biological activities normally associated with the native polypeptide. In the context of the present invention, antagonists may include proteins, nucleic acids, carbohydrates, antibodies or any other molecules that decrease the effect of a biologically active protein.

A "defined medium" refers to a medium comprising nutritional and hormonal requirements necessary for the survival and/or growth of the cells in culture such that the components of the medium are known. Traditionally, the defined medium has been formulated by the addition of nutritional and growth factors necessary for growth and/or survival. Typically, the defined medium provides at least one component from one or more of the following categories: a) all essential amino acids, and usually the basic set of twenty amino acids plus cysteine; b) an energy source, usually in the form of a carbohydrate such as glucose; c) vitamins and/or other organic compounds required at low concentrations; d) free fatty acids; and e) trace elements, where trace elements are defined as inorganic compounds or naturally occurring elements that are typically required at very low concentrations, usually in the micromolar range. The defined medium may also optionally be supplemented with one or more components from any of the following categories: a) one or more mitogenic agents; b) salts and buffers as, for example, calcium, magnesium, and phosphate; c) nucleosides and bases such as, for example, adenosine and thymidine, hypoxanthine; and d) protein and tissue hydrolysates.

The term "agonist" is used in the broadest sense and includes any molecule that mimics a biological activity of a native polypeptide disclosed herein. Suitable agonist molecules specifically include agonist antibodies or antibody fragments, fragments or amino acid sequence variants of native polypeptides, peptides, small organic molecules, etc. Methods for identifying agonists of a native polypeptide may comprise contacting a native polypeptide with a candidate agonist molecule and measuring a detectable change in one or more biological activities normally associated with the native polypeptide.

"Inhibition constant", or "Ki", are used interchangeably and mean the dissociation constant of the enzyme-inhibitor complex, or the reciprocal of the binding affinity of the inhibitor to the enzyme.

As used herein, "treat" or "treating," or "palliating" or "ameliorating" are used interchangeably and mean administering a drug or a biologic to achieve a therapeutic benefit, to cure or reduce the severity of an existing condition, or to achieve a prophylactic benefit, prevent or reduce the likelihood of onset or severity the occurrence of a condition. By therapeutic benefit is meant eradication or amelioration of the underlying condition being treated or one or more of the physiological symptoms associated with the underlying condition such that an improvement is observed in the subject, notwithstanding that the subject may still be afflicted with the underlying condition.

A "therapeutic effect" or "therapeutic benefit," as used herein, refers to a physiologic effect, including but not limited to the mitigation, amelioration, or prevention of disease in humans or other animals, or to otherwise enhance physical or mental wellbeing of humans or animals, resulting from administration of a polypeptide of the invention other than the ability to induce the production of an antibody against an antigenic epitope possessed by the biologically active protein. For prophylactic benefit, the compositions may be administered to a subject at risk of developing a particular disease, condition or symptom of the disease (e.g., a bleed in a diagnosed hemophilia A subject), or to a subject reporting one or more of the physiological symptoms of a disease, even though a diagnosis of this disease may not have been made.

The terms "therapeutically effective amount" and "therapeutically effective dose", as used herein, refer to an amount of a drug or a biologically active protein, either alone or as a part of a polypeptide composition, that is capable of having any detectable, beneficial effect on any symptom, aspect, measured parameter or characteristics of a disease state or condition when administered in one or repeated doses to a subject. Such effect need not be absolute to be beneficial. Determination of a therapeutically effective amount is well within the capability of those skilled in the art, especially in light of the detailed disclosure provided herein.

The term "therapeutically effective dose regimen", as used herein, refers to a schedule for consecutively administered multiple doses (i.e., at least two or more) of a biologically active protein, either alone or as a part of a polypeptide composition, wherein the doses are given in therapeutically effective amounts to result in sustained beneficial effect on any symptom, aspect, measured parameter or characteristics of a disease state or condition.

I). General Techniques

The practice of the present invention employs, unless otherwise indicated, conventional techniques of immunology, biochemistry, chemistry, molecular biology, microbiology, cell biology, genomics and recombinant DNA, which are within the skill of the art. See Sambrook, J. et al., "Molecular Cloning: A Laboratory Manual," $3^{rd}$ edition, Cold Spring Harbor Laboratory Press, 2001; "Current protocols in molecular biology", F. M. Ausubel, et al. eds., 1987; the series "Methods in Enzymology," Academic Press, San Diego, Calif.; "PCR 2: a practical approach", M. J. MacPherson, B. D. Hames and G. R. Taylor eds., Oxford University Press, 1995; "Antibodies, a laboratory manual" Harlow, E. and Lane, D. eds., Cold Spring Harbor Laboratory, 1988; "Goodman & Gilman's The Pharmacological Basis of Therapeutics," $11^{th}$ Edition, McGraw-Hill, 2005; and Freshney, R. I., "Culture of Animal Cells: A Manual of Basic Technique," $4^{th}$ edition, John Wiley & Sons, Somerset, N J, 2000, the contents of which are incorporated in their entirety herein by reference.

Host cells can be cultured in a variety of media. Commercially available media such as Ham's F10 (Sigma), Minimal Essential Medium (MEM, Sigma), RPMI-1640 (Sigma), and Dulbecco's Modified Eagle's Medium (DMEM, Sigma) are suitable for culturing eukaryotic cells. In addition, animal cells can be grown in a defined medium that lacks serum but is supplemented with hormones, growth factors or any other factors necessary for the survival and/or growth of a particular cell type. Whereas a defined medium supporting cell survival maintains the viability, morphology, capacity to metabolize and potentially, capacity of the cell to differentiate, a defined medium promoting cell growth provides all chemicals necessary for cell proliferation or multiplication. The general parameters governing mammalian cell survival and growth in vitro are well established in the art. Physicochemical parameters which may be controlled in different cell culture systems are, e.g., pH, $pO_2$, temperature, and osmolarity. The nutritional requirements of cells are usually provided in standard media formulations developed to provide an optimal environment. Nutrients can be divided into several categories: amino acids and their derivatives, carbohydrates, sugars, fatty acids, complex lipids, nucleic acid derivatives and vitamins. Apart from nutrients for maintaining cell metabolism, most cells also require one or more hormones from at least one of the following groups: steroids, prostaglandins, growth factors, pituitary hormones, and peptide hormones to proliferate in serum-free media (Sato, G. H., et al. in "Growth of Cells in Hormonally Defined Media", Cold Spring Harbor Press, N.Y., 1982). In addition to hormones, cells may require transport proteins such as transferrin (plasma iron transport protein), ceruloplasmin (a copper transport protein), and high-density lipoprotein (a lipid carrier) for survival and growth in vitro. The set of optimal hormones or transport proteins will vary for each cell type. Most of these hormones or transport proteins have been added exogenously or, in a rare case, a mutant cell line has been found which does not require a particular factor. Those skilled in the art will know of other factors required for maintaining a cell culture without undue experimentation.

Growth media for growth of prokaryotic host cells include nutrient broths (liquid nutrient medium) or LB medium (Luria Bertani). Suitable media include defined and undefined media. In general, media contains a carbon source such as glucose needed for bacterial growth, water, and salts. Media may also include a source of amino acids and nitrogen, for example beef or yeast extract (in an undefined medium) or known quantities of amino acids (in a defined medium). In some embodiments, the growth medium is LB broth, for example LB Miller broth or LB Lennox broth. LB broth comprises peptone (enzymatic digestion product of casein), yeast extract and sodium chloride. In some embodiments, a selective medium is used which comprises an antibiotic. In this medium, only the desired cells possessing resistance to the antibiotic will grow.

II). XTEN Protein Polymer and Conjugate Compositions

The present invention relates, in part, to substantially homogeneous compositions comprising extended recombinant polypeptides (XTEN). In a first aspect, the invention provides XTEN compositions that are substantially homogeneous in length. Such compositions are useful as reagent conjugation partners to create XTEN-cross-linker intermediates and XTEN-payload compositions. Additionally, it is an object of the present invention to provide methods to create the substantially homogeneous XTEN compositions. The present invention also provides methods to create such substantially homogeneous XTEN compositions at high yield.

In a second aspect, the invention provides XTEN. For example, the XTENs capable of linking to one or more payload conjugation partners, resulting in payload-XTEN conjugates are specifically engineered to incorporate defined numbers of reactive amino acids for linking to the payloads either directly or via cross-linkers or azide/alkyne reactants. The present invention also provides methods to create such engineered XTEN polymers for use in creating conjugates with payload agents of interest as compositions with enhanced pharmaceutical properties, including enhanced pharmacokinetic and pharmacologic properties, as well as reduced toxicity.

In another aspect, the invention provides substantially homogeneous XTEN polymers comprising defined numbers of cross-linkers or azide/alkyne reactants as reactant conjugation partners in monomeric and multimeric configurations and methods of the preparation of such reactants. The XTEN derivatives comprising cross-linkers or azide/alkyne reactants are used as reactants in the conjugation of payload agents to result in XTEN-payload conjugate exhibiting the desired physical, pharmaceutical, and pharmacological properties.

In another aspect, the invention provides compositions of XTEN-payload in which one or more XTEN are chemically linked to one or more payloads, including combinations of different payloads, in defined numbers in either monomeric or multimeric configurations to provide compositions with enhanced pharmaceutical, pharmacokinetic, and pharmacologic properties. Such compositions linked to such payloads may have utility, when administered to a subject, in the prevention, treatment or amelioration of diseases or conditions due to a pharmacologic or biologic effect of the payload.

1. XTEN: Extended Recombinant Polypeptides

In one aspect, the invention provides substantially homogeneous XTEN polypeptide compositions that are useful as conjugation partners to link to one or more payloads, either directly or via a cross-linker reactant resulting in an XTEN-payload conjugate.

XTEN are polypeptides with non-naturally occurring, substantially non-repetitive sequences having a low degree or no secondary or tertiary structure under physiologic conditions. XTEN typically have from about 36 to about 3000 amino acids, of which the majority or the entirety are small hydrophilic amino acids. As used herein, "XTEN" specifically excludes whole antibodies or antibody fragments (e.g. single-chain antibodies and Fc fragments). XTEN polypeptides have utility as a conjugation partners in that they serve in various roles, conferring certain desirable properties when linked to a payload. The resulting XTEN-payload conjugates have enhanced properties, such as enhanced pharmacokinetic, physicochemical, pharmacologic, and pharmaceutical properties compared to the corresponding payload not linked to XTEN, making them useful in the treatment of certain conditions for which the payload is known in the art to be used.

The unstructured characteristic and physicochemical properties of the XTEN result, in part, from the overall amino acid composition that is disproportionately limited to 4-6 types of hydrophilic amino acids, the linking of the amino acids in a quantifiable non-repetitive design, and the length of the XTEN polypeptide. In an advantageous feature common to XTEN but uncommon to native polypeptides, the properties of XTEN disclosed herein are not tied to absolute primary amino acid sequences, as evidenced by the diversity of the exemplary sequences of Table 2 that, within varying ranges of length, possess similar properties, many of which are documented in the Examples. Accordingly, XTEN have properties more like non-proteinaceous, hydrophilic polymers than they do proteins. The XTEN of the present invention exhibit one or more of the following advantageous properties: conformational flexibility, reduced or lack of secondary structure, high degree of aqueous solubility, high degree of protease resistance, low immunogenicity, low binding to mammalian receptors, a defined degree of charge, and increased hydrodynamic (or Stokes) radii; properties that are similar to certain hydrophilic polymers (e.g., polyethylene glycol) that make them particularly useful as conjugation partners.

The XTEN component(s) of the subject conjugates are designed to behave like denatured peptide sequences under physiological conditions, despite the extended length of the polymer. "Denatured" describes the state of a peptide in solution that is characterized by a large conformational freedom of the peptide backbone. Most peptides and proteins adopt a denatured conformation in the presence of high concentrations of denaturants or at elevated temperature. Peptides in denatured conformation have, for example, characteristic circular dichroism (CD) spectra and are characterized by a lack of long-range interactions as determined by NMR. "Denatured conformation" and "unstructured conformation" are used synonymously herein. In some embodiments, the invention provides XTEN sequences that, under physiologic conditions, resemble denatured sequences that are largely devoid of secondary structure. In other cases, the XTEN sequences are substantially devoid of secondary structure under physiologic conditions. "Largely devoid," as used in this context, means that less than 50% of the XTEN amino acid residues of the XTEN sequence contribute to secondary structure as measured or determined by the means described herein. "Substantially devoid," as used in this context, means that at least about 60%, or about 70%, or about 80%, or about 90%, or about 95%, or about 97%, or at least about 99% of the XTEN amino acid residues of the XTEN sequence do not contribute to secondary structure, as measured or determined by the methods described herein.

A variety of methods and assays are known in the art for determining the physicochemical properties of the subject XTEN. Such properties include but are not limited to secondary or tertiary structure, solubility, protein aggregation, stability, absolute and apparent molecular weight, purity and uniformity, melting properties, contamination and water content. The methods to measure such properties include analytical centrifugation, EPR, HPLC-ion exchange, HPLC-size exclusion chromatography (SEC), HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. In particular, secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra, as does the lack of these structure elements. Secondary structure can also be predicted for a polypeptide sequence via certain computer programs or algorithms, such as the well-known Chou-Fasman algorithm (Chou, P. Y., et al. (1974) *Biochemistry*, 13: 222-45) and the Garnier-Osguthorpe-Robson algorithm ("Gor algorithm") (Garnier J, Gibrat J F, Robson B. (1996), GOR method for predicting protein secondary structure from amino acid sequence. Methods Enzymol 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure). Polypeptide sequences can be analyzed using the Chou-Fasman algorithm using sites on the world wide web at, for example, fasta.bioch.virginia.edu/fasta_www2/fasta_www.cgi?rm=misc1 and the Gor algorithm at npsa-pbil.ibcp.fr/cgi-bin/npsa_automat.pl?page=npsa_gor4.html (both accessed on Sep. 5, 2012). Additional methods are disclosed in Arnau, et al., Prot Expr and Purif (2006) 48, 1-13.

In one embodiment, the XTEN sequences used in the subject conjugates have an alpha-helix percentage ranging from 0% to less than about 5% as determined by the Chou-Fasman algorithm. In another embodiment, the XTEN sequences have a beta-sheet percentage ranging from 0% to less than about 5% as determined by the Chou-Fasman algorithm. In one embodiment, the XTEN sequences of the conjugates have an alpha-helix percentage ranging from 0% to less than about 5% and a beta-sheet percentage ranging from 0% to less than about 5% as determined by the Chou-Fasman algorithm. In one embodiment, the XTEN sequences of the conjugates have an alpha-helix percentage less than about 2% and a beta-sheet percentage less than about 2%. The XTEN sequences of the conjugate compositions have a high degree of random coil percentage, as determined by the GOR algorithm. In some embodiments, an XTEN sequence has at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, and most preferably at least about 99% random coil, as determined by the GOR algorithm. In one embodiment, the XTEN sequences of the conjugate compositions have an alpha-helix percentage ranging from 0% to less than about 5% and a beta-sheet percentage ranging from 0% to less than about 5% as determined by the Chou-Fasman algorithm and at least about 90% random coil, as determined by the GOR algorithm. In another embodiment, the XTEN sequences of the disclosed compositions have an alpha-helix percentage less than about 2% and a beta-sheet percentage less than about 2% at least about 90% random coil, as determined by the GOR algorithm. In another embodiment, the XTEN sequences of the compositions are substantially lacking secondary structure as measured by circular dichroism.

The selection criteria for the XTEN to be linked to the payload used to create the conjugate compositions generally relate to attributes of physicochemical properties and conformational structure of the XTEN that is, in turn, used to confer enhanced pharmaceutical, pharmacologic, and pharmacokinetic properties to the compositions.

1. Non-Repetitive Sequences

It is specifically contemplated that the subject XTEN sequences included in the subject conjugate composition embodiments are substantially non-repetitive. In general, repetitive amino acid sequences have a tendency to aggregate or form higher order structures, as exemplified by natural repetitive sequences such as collagens and leucine zippers. These repetitive amino acids may also tend to form contacts resulting in crystalline or pseudocrystaline structures. In contrast, the low tendency of non-repetitive sequences to aggregate enables the design of long-sequence XTENs with a relatively low frequency of charged amino acids that would otherwise be likely to aggregate if the sequences were repetitive. The non-repetitiveness of a subject XTEN can be observed by assessing one or more of the following features. In one embodiment, a substantially non-repetitive XTEN sequence has no three contiguous amino acids in the sequence that are identical amino acid types unless the amino acid is serine, in which case no more than three contiguous amino acids are serine residues. In another embodiment, as described more fully below, a substantially non-repetitive XTEN sequence in which 80-99% of the sequence is comprised of motifs of 9 to 14 amino acid residues wherein the motifs consist of 3, 4, 5 or 6 types of amino acids selected from glycine (G), alanine (A), serine (S), threonine (T), glutamate (E) and proline (P), and wherein the sequence of any two contiguous amino acid residues in any one motif is not repeated more than twice in the sequence motif.

The degree of repetitiveness of a polypeptide or a gene can be measured by computer programs or algorithms or by other means known in the art. According to the current invention, algorithms to be used in calculating the degree of repetitiveness of a particular polypeptide, such as an XTEN, are disclosed herein, and examples of sequences analyzed by algorithms are provided (see Examples, below). In one embodiment, the repetitiveness of a polypeptide of a predetermined length can be calculated (hereinafter "subsequence score") according to the formula given by Equation I:

$$\text{Subsequence score} = \frac{\sum_{i=1}^{m}\text{Count}_i}{m} \qquad \text{I}$$

wherein: m=(amino acid length of polypeptide)−(amino acid length of subsequence)+1; and $\text{Count}_i$=cumulative number of occurrences of each unique subsequence within $\text{sequence}_i$.

Figure 79:
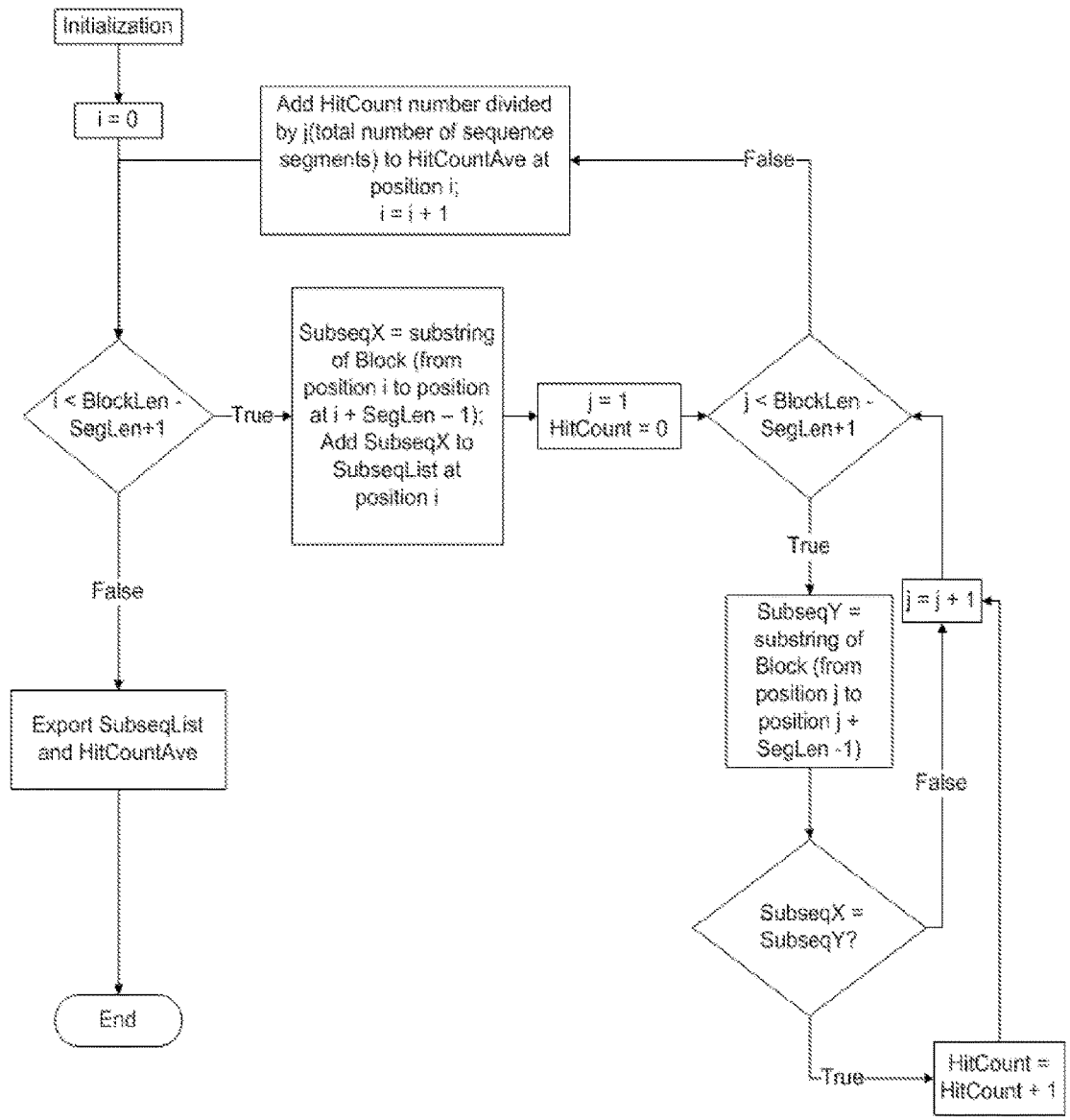
FIG. 79 is a schematic of the logic flow chart of the algorithm SegScore (Example 59). In the figure the following legend applies: i, j—counters used in the control loops that run through the entire sequence; HitCount—this variable is a counter that keeps track of how many times a subsequence encounters an identical subsequence in a block; SubSeqX—this variable holds the subsequence that is being checked for redundancy; SubSeqY—this variable holds the subsequence that the SubSeqX is checked against; BlockLen—this variable holds the user determined length of the block; SegLen—this variable holds the length of a segment. The program is hardcoded to generate scores for subsequences of lengths 3, 4, 5, 6, 7, 8, 9, and 10; Block—this variable holds a string of length BlockLen. The string is composed of letters from an input XTEN sequence and is determined by the position of the i counter; SubSeqList—this is a list that holds all of the generated subsequence scores.

An algorithm termed "SegScore" was developed to apply the foregoing equation to quantitate repetitiveness of polypeptides, such as an XTEN, providing the subsequence score wherein sequences of a predetermined amino acid length "n" are analyzed for repetitiveness by determining the number of times (a "count") a unique subsequence of length "s" appears in the set length, divided by the absolute number of subsequences within the predetermined length of the sequence. FIG. 79 depicts a logic flowchart of the SegScore algorithm, while FIG. 80 portrays a schematic of how a subsequence score is derived for a fictitious XTEN with 11 amino acids and a subsequence length of 3 amino acid residues. For example, a predetermined polypeptide length of 200 amino acid residues has 192 overlapping 9-amino acid subsequences and 198 3-mer subsequences, but the subsequence score of any given polypeptide will depend on the absolute number of unique subsequences and how frequently each unique subsequence (meaning a different amino acid sequence) appears in the predetermined length of the sequence.

In the context of the present invention, "subsequence score" means the sum of occurrences of each unique 3-mer frame across 200 consecutive amino acids of the cumulative XTEN polypeptide divided by the absolute number of unique 3-mer subsequences within the 200 amino acid sequence. Examples of such subsequence scores derived from 200 consecutive amino acids of repetitive and non-repetitive polypeptides are presented in Example 45. In one embodiment, the invention provides a XTEN-payload comprising one XTEN in which the XTEN has a subsequence score less than 12, more preferably less than 10, more preferably less than 9, more preferably less than 8, more preferably less than 7, more preferably less than 6, and most preferably less than 5. In another embodiment, the invention provides XTEN-cross-linker conjugates comprising an XTEN in which the XTEN have a subsequence score of less than 10, more preferably less than 9, more preferably less than 8, more preferably less than 7, more preferably less than 6, and most preferably less than 5. In another embodiment, the invention provides XTEN-click-chemistry conjugates comprising an XTEN in which the XTEN have a subsequence score of less than 10, more preferably less than 9, more preferably less than 8, more preferably less than 7, more preferably less than 6, and most preferably less than 5. In yet another embodiment, the invention provides XTEN conjugate compositions comprising at least two linked XTEN in which each individual XTEN has a subsequence score of less than 10, or less than 9, or less than 8, or less than 7, or less than 6, or less than 5, or less. In yet another embodiment, the invention provides XTEN conjugate compositions comprising at least three linked XTEN in which each individual XTEN has a subsequence score of less than 10, or less than 9, or less than 8, or less than 7, or less than 6, or less than 5, or less. In the embodiments of the XTEN compositions described herein, an XTEN with a subsequence score of 10 or less (i.e., 9, 8, 7, etc.) is characterized as substantially non-repetitive.

In one aspect, the non-repetitive characteristic of XTEN of the present invention together with the particular types of amino acids that predominate in the XTEN, rather than the absolute primary sequence, confers one or more of the enhanced physicochemical and biological properties of the XTEN and the resulting XTEN-payload conjugates. These enhanced properties include a higher degree of expression of the XTEN protein in the host cell, greater genetic stability of the gene encoding XTEN, a greater degree of solubility, less tendency to aggregate, and enhanced pharmacokinetics of the resulting conjugate compared to payloads not conjugated to XTEN or payloads conjugated to proteins having repetitive sequences. These enhanced properties permit more efficient manufacturing, greater uniformity of the final product, lower cost of goods, and/or facilitate the formulation of XTEN-comprising pharmaceutical preparations containing extremely high protein concentrations, in some cases exceeding 100 mg/ml. In some embodiments, the XTEN polypeptide sequences of the conjugates are designed to have a low degree of internal repetitiveness in order to reduce or substantially eliminate immunogenicity when administered to a mammal. Polypeptide sequences composed of short, repeated motifs largely limited to only three amino acids, such as glycine, serine and glutamate, may result in relatively high antibody titers when administered to a mammal despite the absence of predicted T-cell epitopes in these sequences. This may be caused by the repetitive nature of polypeptides, as it has been shown that immunogens with repeated epitopes, including protein aggregates, cross-linked immunogens, and repetitive carbohydrates are highly immunogenic and can, for example, result in the cross-linking of B-cell receptors causing B-cell activation. (Johansson, J., et al. (2007) Vaccine, 25:1676-82; Yankai, Z., et al. (2006) Biochem Biophys Res Commun, 345:1365-71; Hsu, C. T., et al. (2000) Cancer Res, 60:3701-5); Bachmann M F, et al. Eur J Immunol. (1995) 25(12):3445-3451).

2. Exemplary Sequence Motifs

Figure 18:
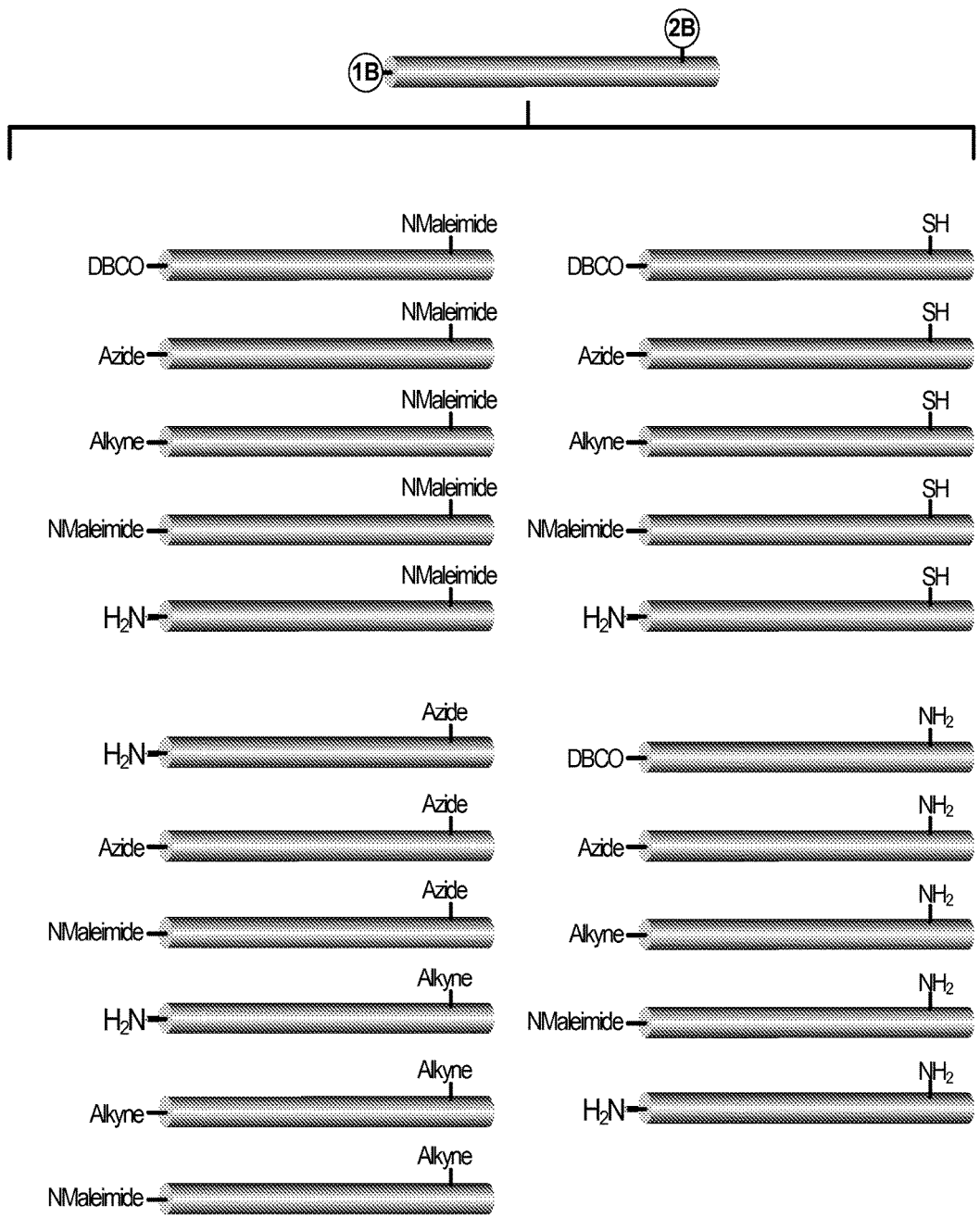
FIG. 18 shows exemplary permutations of XTEN-cross-linker precursor segments with two reactive groups of cross-linkers or reactive groups of an incorporated amino acid that are used as reactants to link to payloads or to other XTEN reactants. The 1B and 2B represent reactive groups that will, in other figures, react with a like-numbered reactive group; 1 with 1 and 2 with 2, etc.
Figure 20:
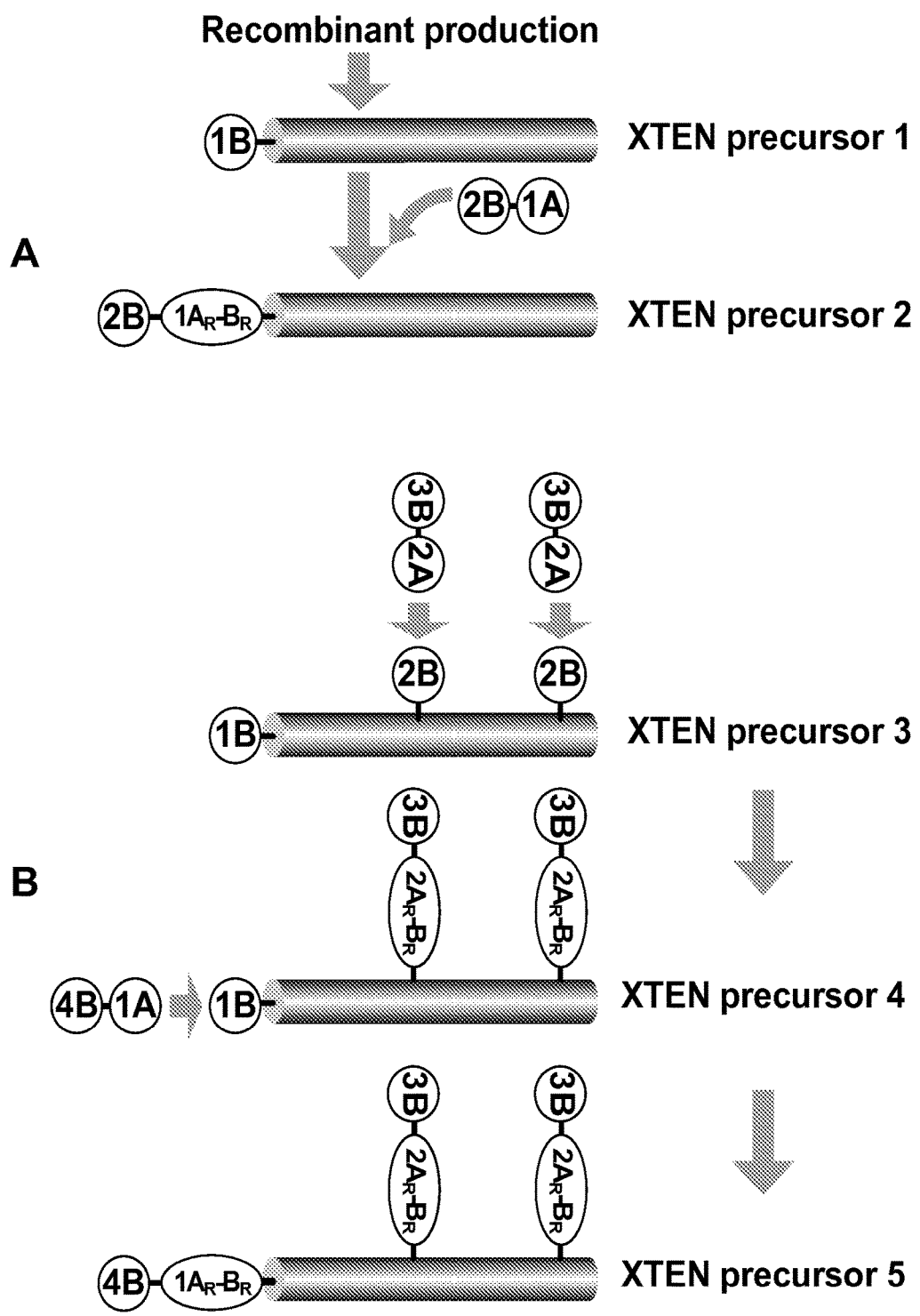
FIG. 20 illustrates the creation of various XTEN precursor segments.

The present invention encompasses XTEN used as conjugation partners that comprise multiple units of shorter sequences, or motifs, in which the amino acid sequences of the motifs are substantially non-repetitive. The non-repetitive property can be met even using a "building block" approach using a library of sequence motifs that are multimerized to create the XTEN sequences, as shown in FIGS. 18-19. While an XTEN sequence may consist of multiple units of as few as four different types of sequence motifs, because the motifs themselves generally consist of non-repetitive amino acid sequences, the overall XTEN sequence is designed to render the sequence substantially non-repetitive.

In one embodiment, an XTEN has a substantially non-repetitive sequence of greater than about 36 to about 3000, or about 100 to about 2000, or about 144 to about 1000 amino acid residues, wherein at least about 80%, or at least about 85%, or at least about 90%, or at least about 95%, or at least about 97%, or about 99% to about 100% of the XTEN sequence consists of non-overlapping sequence motifs, and wherein each of the motifs has about 9 to 36 amino acid residues. As used herein, "non-overlapping" means that the individual motifs do not share amino acid residues but, rather, are fused to other motifs or amino acid residues in a linear fashion. In other embodiments, at least about 80%, or at least about 85%, or at least about 90%, or at least about 95%, or at least about 97%, or about 99% to about 100% of the XTEN sequence consists of non-overlapping sequence motifs wherein each of the motifs has 9 to 14 amino acid residues. In still other embodiments, at least about 80%, or at least about 85%, or at least about 90%, or at least about 95%, or at least about 97%, or about 99% to about 100% of the XTEN sequence consists of non-overlapping sequence motifs wherein each of the motifs has 12 amino acid residues. In these embodiments, it is preferred that the sequence motifs are composed of substantially (e.g., 90% or more) or exclusively small hydrophilic amino acids, such that the overall sequence has an unstructured, flexible characteristic. Examples of amino acids that are included in XTEN are, e.g., arginine, lysine, threonine, alanine, asparagine, glutamine, aspartate, glutamate, serine, and glycine. In one embodiment, XTEN sequences have predominately four to six types of amino acids selected from glycine (G), alanine (A), serine (S), threonine (T), glutamate (E) or proline (P) that are arranged in a substantially non-repetitive sequence that is about 36 to about 3000, or about 100 to about 2000, or about 144 to about 1000 amino acid residues in length. In some embodiment, an XTEN sequence is made of 4, 5, or 6 types of amino acids selected from the group consisting of glycine (G), alanine (A), serine (S), threonine (T), glutamate (E) or proline (P). In some embodiments, XTEN have sequences of about 36 to about 1000, or about 100 to about 2000, or about 400 to about 3000 amino acid residues wherein at least about 80% of the sequence consists of non-overlapping sequence motifs wherein each of the motifs has 9 to 36 amino acid residues and wherein at least 90%, or at least 91%, or at least 92%, or at least 93%, or at least 94%, or at least 95%, or at least 96%, or at least 97%, or 100% of each of the motifs consists of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 9 to 36 amino acid residues wherein the motifs consist of 4 to 6 types of amino acids selected from glycine (G), alanine (A), serine (S), threonine (T), glutamate (E) and proline (P), and wherein the content of any one amino acid type in the full-length XTEN does not exceed 40%, or about 30%, or 25%, or about 17%, or about 12%, or about 8%. In other embodiments, at least about 90% of the XTEN sequence consists of non-overlapping sequence motifs wherein each of the motifs has 12 amino acid residues consisting of 4 to 6 types of amino acids selected from glycine (G), alanine (A), serine (S), threonine (T), glutamate (E) and proline (P), and wherein the content of any one amino acid type in the full-length XTEN does not exceed 40%, or 30%, or about 25%, or about 17%, or about 12%, or about 8%. In yet other embodiments, at least about 90%, or about 91%, or about 92%, or about 93%, or about 94%, or about 95%, or about 96%, or about 97%, or about 98%, or about 99%, to about 100% of the XTEN sequence consists of non-overlapping sequence motifs wherein each of the motifs has 12 amino acid residues consisting of glycine (G), alanine (A), serine (S), threonine (T), glutamate (E) and proline (P).

In some embodiments, the invention provides XTEN-payload, XTEN-cross-linker, and XTEN-click-chemistry reactant conjugates comprising one, or two, or three, or four or more substantially non-repetitive XTEN sequence(s) of about 36 to about 1000 amino acid residues, or cumulatively about 100 to about 3000 amino acid residues wherein at least about 80%, or at least about 90%, or about 91%, or about 92%, or about 93%, or about 94%, or about 95%, or about 96%, or about 97%, or about 98%, or about 99% to about 100% of the sequence consists of multiple units of four or more non-overlapping sequence motifs selected from the amino acid sequences of Table 1, wherein the overall sequence remains substantially non-repetitive. In some embodiments, the XTEN comprises non-overlapping sequence motifs in which about 80%, or at least about 85%, or at least about 90/o, or about 91%, or about 92%, or about 93%, or about 94%, or about 95%, or about 96%, or about 97%, or about 98%, or about 99% or about 100% of the sequence consists of multiple units of non-overlapping sequences selected from a single motif family selected from Table 1, resulting in a family sequence. Family, as applied to motifs, means that the XTEN has motifs selected from a single motif category from Table 1; i.e., AD, AE, AF, AG, AM, AQ, BC, or BD. In other embodiments, the XTEN comprises multiple units of motif sequences from two or more of the motif families of Table 1 selected to achieve desired physicochemical characteristics, including such properties as net charge, hydrophilicity, lack of secondary structure, or lack of repetitiveness that may be conferred by the amino acid composition of the motifs, described more fully below. In the embodiments hereinabove described in this paragraph, the motifs or portions of the motifs incorporated into the XTEN can be selected and assembled using the methods described herein to achieve an XTEN of about 36, about 42, about 72, about 144, about 288, about 576, about 864, about 1000, about 2000 to about 3000 amino acid residues, or any intermediate length. Non-limiting examples of XTEN family sequences useful for incorporation into the subject conjugates are presented in Table 2. It is intended that a specified sequence mentioned relative to Table 2 has that sequence set forth in Table 2, while a generalized reference to an AE144 sequence, for example, is intended to encompass any AE sequence having 144 amino acid residues; e.g., AE144_1A, AE144_2A, etc., or a generalized reference to an AG144 sequence, for example, is intended to encompass any AG sequence having 144 amino acid residues, e.g., AG144_1, AG144_2, AG144_A, AG144_B, AG144_C, etc.

TABLE 1

XTEN Sequence Motifs of 12
Amino Acids and Motif Families

| Motif Family* | MOTIF SEQUENCE | SEQ ID NO: |
|---|---|---|
| AD | GESPGGSSGSES | 26 |
| AD | GSEGSSGPGESS | 27 |
| AD | GSSESGSSEGGP | 28 |
| AD | GSGGEPSESGSS | 29 |
| AE, AM | GSPAGSPTSTEE | 30 |
| AE, AM, AQ | GSEPATSGSETP | 31 |
| AE, AM, AQ | GTSESATPESGP | 32 |
| AE, AM, AQ | GTSTEPSEGSAP | 33 |
| AF, AM | GSTSESPSGTAP | 34 |
| AF, AM | GTSTPESGSASP | 35 |
| AF, AM | GTSPSGESSTAP | 36 |
| AF, AM | GSTSSTAESPGP | 37 |
| AG, AM | GTPGSGTASSSP | 38 |
| AG, AM | GSSTPSGATGSP | 39 |
| AG, AM | GSSPSASTGTGP | 40 |
| AG, AM | GASPGTSSTGSP | 41 |
| AQ | GEPAGSPTSTSE | 42 |
| AQ | GTGEPSSTPASE | 43 |
| AQ | GSGPSTESAPTE | 44 |
| AQ | GSETPSGPSETA | 45 |
| AQ | GPSETSTSEPGA | 46 |
| AQ | GSPSEPTEGTSA | 47 |
| BC | GSGASEPTSTEP | 48 |
| BC | GSEPATSGTEPS | 49 |
| BC | GTSEPSTSEPGA | 50 |
| BC | GTSTEPSEPGSA | 51 |
| BD | GSTAGSETSTEA | 52 |
| BD | GSETATSGSETA | 53 |
| BD | GTSESATSESGA | 54 |
| BD | GTSTEASEGSAS | 55 |

*Denotes individual motif sequences that, when used together in various permutations, results in a "family sequence"

TABLE 2

XTEN Polypeptides

| XTEN Name | Amino Acid Sequence | SEQ ID NO: |
|---|---|---|
| AE42 | GAPGSPAGSPTSTEEGTSESATPESGPGSEPATSGSETPASS | 56 |
| AE42_1 | TEPSEGSAPGSPAGSPTSTEEGTSESATPESGPGSEPATSGS | 57 |
| AE42_2 | PAGSPTSTEEGTSTEPSEGSAPGTSESATPESGPGSEPATSG | 58 |
| AE42_3 | SEPATSGSETPGTSESATPESGPGTSTEPSEGSAPGSPAGSP | 59 |
| AG42_1 | GAPSPSASTGTGPGTPGSGTASSSPGSSTPSGATGSPGPSGP | 60 |

TABLE 2-continued

XTEN Polypeptides

| XTEN Name | Amino Acid Sequence | SEQ ID NO: |
|---|---|---|
| AG42_2 | GPGTPGSGTASSSPGSSTPSGATGSPGSSPSASTGTGPGASP | 61 |
| AG42_3 | SPSASTGTGPGASPGTSSTGSPGTPGSGTASSSPGSSTPSGA | 62 |
| AG42_4 | SASTGTGPGASPGTSSTGSPGTPGSGTASSSPGSSTPSGATG | 63 |
| AE48 | MAEPAGSPTSTEEGTPGSGTASSSPGSSTPSGATGSPGASPGTSSTGS | 64 |
| AM48 | MAEPAGSPTSTEEGASPGTSSTGSPGSSTPSGATGSPGSSTPSGATGS | 65 |
| AE144 | GSEPATSGSETPGTSESATPESGPGSEPATSGSETPGSPAGSPTSTEEGTSTEPSEGSA PGSEPATSGSETPGSEPATSGSETPGSEPATSGSETPGTSTEPSEGSAPGTSESATPES GPGSEPATSGSETPGTSTEPSEGSAP | 66 |
| AE144_1A | SPAGSPTSTEEGTSESATPESGPGTSTEPSEGSAPGSPAGSPTSTEEGTSTEPSEGSAP GTSTEPSEGSAPGTSESATPESGPGSEPATSGSETPGSEPATSGSETPGSPAGSPTSTE EGTSESATPESGPGTSTEPSEGSAPG | 67 |
| AE144_2A | TSTEPSEGSAPGSPAGSPTSTEEGTSTEPSEGSAPGTSTEPSEGSAPGTSESATPESGP GTSTEPSEGSAPGTSESATPESGPGSEPATSGSETPGTSTEPSEGSAPGTSTEPSEGSA PGTSESATPESGPGTSESATPESGPG | 68 |
| AE144_2B | TSTEPSEGSAPGSPAGSPTSTEEGTSTEPSEGSAPGTSTEPSEGSAPGTSESATPESGP GTSTEPSEGSAPGTSESATPESGPGSEPATSGSETPGTSTEPSEGSAPGTSTEPSEGSA PGTSESATPESGPGTSESATPESGPG | 69 |
| AE144_3A | SPAGSPTSTEEGTSESATPESGPGSEPATSGSETPGTSESATPESGPGTSTEPSEGSAP GTSTEPSEGSAPGTSTEPSEGSAPGTSTEPSEGSAPGTSTEPSEGSAPGTSTEPSEGSA PGSPAGSPTSTEEGTSTEPSEGSAPG | 70 |
| AE144_3B | SPAGSPTSTEEGTSESATPESGPGSEPATSGSETPGTSESATPESGPGTSTEPSEGSAP GTSTEPSEGSAPGTSTEPSEGSAPGTSTEPSEGSAPGTSTEPSEGSAPGTSTEPSEGSA PGSPAGSPTSTEEGTSTEPSEGSAPG | 71 |
| AE144_4A | TSESATPESGPGSEPATSGSETPGTSESATPESGPGSEPATSGSETPGTSESATPESGP GTSTEPSEGSAPGTSESATPESGPGSPAGSPTSTEEGSPAGSPTSTEEGSPAGSPTSTE EGTSESATPESGPGTSTEPSEGSAPG | 72 |
| AE144_4B | TSESATPESGPGSEPATSGSETPGTSESATPESGPGSEPATSGSETPGTSESATPESGP GTSTEPSEGSAPGTSESATPESGPGSPAGSPTSTEEGSPAGSPTSTEEGSPAGSPTSTE EGTSESATPESGPGTSTEPSEGSAPG | 73 |
| AE144_5A | TSESATPESGPGSEPATSGSETPGTSESATPESGPGSEPATSGSETPGTSESATPESGP GTSTEPSEGSAPGSPAGSPTSTEEGTSESATPESGPGSEPATSGSETPGTSESATPESG PGSPAGSPTSTEEGSPAGSPTSTEEG | 74 |
| AE144_6B | TSTEPSEGSAPGTSESATPESGPGTSESATPESGPGTSESATPESGPGSEPATSGSETP GSEPATSGSETPGSPAGSPTSTEEGTSTEPSEGSAPGSEPATSGSET PGTSESATPESGPGTSTEPSEGSAPG | 75 |
| AF144 | GTSTPESGSASPGTSPSGESSTAPGTSPSGESSTAPGSTSSTAESPGPGSTSESPSGTA PGSTSSTAESPGPGTSPSGESSTAPGTSPESGSASPGSTSSTAESPGPGTSPSGESST APGTSPSGESSTAP | 76 |
| AG144_1 | SGTASSSPGSSTPSGATGSPGTPGSGTASSSPGSSTPSGATGSPGSSTPSGATGSPGSS PSASTGTGPGSSPSASTGTGPGASPGTSSTGSPGTPGSGTASSSPGSSTPSGATGSPG SSPSASTGTGPGSSPSASTGTGPGASP | 77 |
| AG144_2 | PGSSPSASTGTGPGSSPSASTGTGPGTPGSGTASSSPGSSTPSGATGSPGSSPSASTGT GPGASPGTSSTGSPGTPGSGTASSSPGSSTPSGATGSPGTPGSGTASSSPGASPGTSS TGSPGASPGTSSTGSPGTPGSGTASSS | 78 |
| AG144_A | GASPGTSSTGSPGSSPSASTGTGPGSSPSASTGTGPGTPGSGTASSSPGSSTPSGATG SPGSSPSASTGTGPGASPGTSSTGSPGTPGSGTASSSPGSSTPSGATGSPGTPGSGTA SSSPGASPGTSSTGSPGASPGTSSTGSP | 79 |
| AG144_B | GTPGSGTASSSPGSSTPSGATGSPGASPGTSSTGSPGTPGSGTASSSPGSSTPSGATG SPGSSPSASTGTGPGSSPSASTGTGPGSSTPSGATGSPGSSTPSGATGSPGASPGTSST GSPGASPGTSSTGSPGASPGTSSTGSP | 80 |
| AG144_C | GTPGSGTASSSPGASPGTSSTGSPGASPGTSSTGSPGASPGTSSTGSPGSSPSASTGT GPGTPGSGTASSSPGASPGTSSTGSPGASPGTSSTGSPGASPGTSSTGSPGSSTPSGA TGSPGSSTPSGATGSPGASPGTSSTGSP | 81 |

TABLE 2-continued

XTEN Polypeptides

| XTEN Name | Amino Acid Sequence | SEQ ID NO: |
|---|---|---|
| AG144_F | GSSPSASTGTGPGSSPSASTGTGPGASPGTSSTGSPGASPGTSSTGSPGSSTPSGATG SPGSSPSASTGTGPGASPGTSSTGSPGSSPSASTGTGPGTPGSGTASSSPGSSTPSGAT GSPGSSTPSGATGSPGASPGTSSTGSP | 82 |
| AG144_3 | GTPGSGTASSSPGSSTPSGATGSPGSSTPSGATGSPGSSPSASTGTGPGSSPSASTGT GPGASPGTSSTGSPGTPGSGTASSSPGSSTPSGATGSPGSSPSASTGTGPGSSPSASTG TGPGASPGTSSTGSPGASPGTSSTGSP | 83 |
| AG144_4 | GTPGSGTASSSPGSSTPSGATGSPGSSPSASTGTGPGSSPSASTGTGPGASPGTSSTG SPGASPGTSSTGSPGSSTPSGATGSPGSSPSASTGTGPGASPGTSSTGSPGSSPSASTG TGPGTPGSGTASSSPGSSTPSGATGSP | 84 |
| AE288_1 | GTSESATPESGPGSEPATSGSETPGTSESATPESGPGSEPATSGSETPGTSESATPESG PGTSTEPSEGSAPGSPAGSPTSTEEGTSESATPESGPGSEPATSGSETPGTSESATPES GPGSPAGSPTSTEEGSPAGSPTSTEEGTSTEPSEGSAPGTSESATPESGPGTSESATPE SGPGTSESATPESGPGSEPATSGSETPGSEPATSGSETPGSPAGSPTSTEEGTSTEPSE GSAPGTSTEPSEGSAPGSEPATSGSETPGTSESATPESGPGTSTEPSEGSAP | 85 |
| AE288_2 | GSPAGSPTSTEEGTSESATPESGPGSEPATSGSETPGTSESATPESGPGTSTEPSEGSA PGTSTEPSEGSAPGTSTEPSEGSAPGTSTEPSEGSAPGTSTEPSEGS APGSPAGSPTSTEEGTSTEPSEGSAPGTSESATPESGPGSEPATSGSETPGTSESATPE SGPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAP | 86 |
| AG288_1 | PGASPGTSSTGSPGASPGTSSTGSPGTPGSGTASSSPGSSTPSGATGSPGTPGSGTAS SSPGSSTPSGATGSPGTPGSGTASSSPGSSTPSGATGSPGSSTPSGATGSPGSSPSAST GTGPGSSPSASTGTGPGASPGTSSTGSPGTPGSGTASSSPGSSTPSGATGSPGSSPSAS TGTGPGSSPSASTGTGPGASPGTSSTGSPGASPGTSSTGSPGSSTPSGATGSPGSSPS ASTGTGPGASPGTSSTGSPGSSPSASTGTGPGTPGSGTASSSPGSSTPSGATGS | 87 |
| AG288_2 | GSSPSASTGTGPGSSPSASTGTGPGTPGSGTASSSPGSSTPSGATGSPGSSPSASTGT GPGASPGTSSTGSPGTPGSGTASSSPGSSTPSGATGSPGTPGSGTASSSPGASPGTSS TGSPGASPGTSSTGSPGTPGSGTASSSPGSSTPSGATGSPGASPGTSSTGSPGTPGSG TASSSPGSSTPSGATGSPGSSPSASTGTGPGSSPSASTGTGPGSSTPSGATGSPGSSTP SGATGSPGASPGTSSTGSPGASPGTSSTGSPGASPGTSSTGSPGTPGSGTASSSP | 88 |
| AF504 | GASPGTSSTGSPGSSPSASTGTGPGSSPSASTGTGPGTPGSGTASSSPGSSTPSGATG SPGSXPSASTGTGPGASPGTSSTGSPGTPGSGTASSSPGSSTPSGATGSPGTPGSGTA SSSPGASPGTSSTGSPGASPGTSSTGSPGTPGSGTASSSPGSSTPSGATGSPGASPGTS STGSPGTPGSGTASSSPGSSTPSGATGSPGSXPSASTGTGPGSSPSASTGTGPGSSTPS GATGSPGSSTPSGATGSPGASPGTSSTGSPGASPGTSSTGSPGASPGTSSTGSPGTPG SGTASSSPGASPGTSSTGSPGASPGTSSTGSPGASPGTSSTGSPGSSPSASTGTGPGTP GSGTASSSPGASPGTSSTGSPGASPGTSSTGSPGASPGTSSTGSPGSSTPSGATGSPGS STPSGATGSPGASPGTSSTGSPGTPGSGTASSSPGSSTPSGATGSPGSSTPSGATGSP GSSTPSGATGSPGSSPSASTGTGPGASPGTSSTGSP | 89 |
| AF540 | GSTSSTAESPGPGSTSSTAESPGPGSTSESPSGTAPGSTSSTAESPGPGSTSSTAESPG PGTSTPESGSASPGSTSESPSGTAPGTSPSGESSTAPGSTSESPSGTAPGSTSESPSGT APGTSPSGESSTAPGSTSESPSGTAPGSTSESPSGTAPGTSPSGESSTAPGSTSESPSG TAPGSTSESPSGTAPGSTSESPSGTAPGTSTPESGSASPGSTSESPSGTAPGTSTPESG SASPGSTSSTAESPGPGSTSSTAESPGPGTSTPESGSASPGTSTPESGSASPGSTSESPS GTAPGTSTPESGSASPGTSTPESGSASPGSTSESPSGTAPGSTSESPSGTAPGSTSESP SGTAPGSTSSTAESPGPGTSTPESGSASPGTSTPESGSASPGSTSESPSGTAPGSTSES PSGTAPGTSTPESGSASPGSTSESPSGTAPGSTSESPSGTAPGTSTPESGSASPGTSPS GESSTAPGSTSSTAESPGPGTSPSGESSTAPGSTSSTAESPGPGTSTPESGSASPGSTS ESPSGTAP | 90 |
| AD576 | GSSESGSSEGGPGSGGEPSESGSSGSSESGSSEGGPGSSESGSSEGGPGSSESGSSEG GPGSSESGSSEGGPGSSESGSSEGGPGESPGGSSGSESGSEGSSGPGESSGSSESGSSE GGPGSSESGSSEGGPGSGGEPSESGSSGESPGGSSGSESGESPGGS SGSESGSGGEPSESGSSGSSESGSSEGGPGSGGEPSESGSSGSGGEPSESGSSGSEGSS GPGESSGSPGGSSGSESGSGGEPSESGSSGGGEPSESGSSGSSGGEPSESGSSGSEGSS GSSEGGPGESPGGSSGSESGESPGGSSGSESGESPGGSSGSESGES PGGSSGSESGSSESGGPGSGGEPSESGSSGSEGSSGPGESSGSSESGSSEGGPGS GGEPSESGSSGSSESGSSEGGPGSGGEPSESGSSGESPGGSSGSESGESPGGSSGSES GSSESGGPGSGGEPSESGSSSESGSSEGGPGSGGEPSESGSSGSGGEPSESG SSGESPGGSSGSESGESSGPGESSGSSESGSSEGGPGSEGSSGPGESS | 91 |
| AE576 | GSPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTST EEGTSESATPESGPGTSTEPSEGSAPGTSTEPSEGSAPGSPAGSPTSTEEGTSTEPSEG SAPGTSTEPSEGSAPGTSESATPESGPGTSTEPSEGSAPGTSESATPESGPGSEPATSG SETPGTSESATPESGPGSAPGTSTEPSEGSAPGTSESATPESGPGTSESATPESGPGSP AGSPTSTEEGTSESATPESGPGSEPATSGSETPGTSESATPESGPGTSTEPSEGSAPGTSTEP SEGSAPGTSTEPSEGSAPGTSTEPSEGSAPGTSTEPSEGSAPGSPAG | 92 |

TABLE 2-continued

XTEN Polypeptides

| XTEN Name | Amino Acid Sequence | SEQ ID NO: |
|---|---|---|
| | SPTSTEEGTSTEPSEGSAPGTSESATPESGPGSEPATSGSETPGTSESATPESGPGSEP ATSGSETPGTSESATPESGPGTSTEPSEGSAPGTSESATPESGPGSPAGSPTSTEEGSP AGSPTSTEEGSPAGSPTSTEEGTSESATPESGPGTSTEPSEGSAP | |
| AF576 | GSTSSTAESPGPGSTSSTAESPGPGSTSESPSGTAPGSTSSTAESPGPGSTSSTAESPG PGTSTPESGSASPGSTSESPSGTAPGTSPSGESSTAPGSTSESPSGTAPGSTSESPSGT APGTSPSGESSTAPGSTSESPSGTAPGSTSESPSGTAPGTSPSGESSTAPGSTSESPSG TAPGSTSESPSGTAPGSTSESPSGTAPGSTSTPESGSASPGSTSESPSGTAPGTSTPESG SASPGSTSSTAESPGPGSTSSTAESPGPGTSTPESGSASPGTSTPESGSASPGSTSESPS GTAPGTSTPESGSASPGTSTPESGSASPGSTSESPSGTAPGSTSESPSGTAPGSTSESP SGTAPGSTSSTAESPGPGTSTPESGSASPGTSTPESGSASPGSTSESPSGTAPGSTSES PSGTAPGTSTPESGSASPGSTSESPSGTAPGSTSESPSGTAPGSTSTPESGSASPGTSPS GESSTAPGSTSSTAESPGPGTSPSGESSTAPGSTSSTAESPGPGTSTPESGSASPGSTS ESPSGTAPGSTSSTAESPGPGTSTPESGSASPGTSTPESGSASP | 93 |
| AG576 | PGTPGSGTASSSPGSSTPSGATGSPGSSPSASTGTGPGSSPSASTGTGPGSSTPSGAT GSPGSSTPSGATGSPGASPGTSSTGSPGASPGTSSTGSPGASPGTSSTGSPGTPGSGT ASSSPGASPGTSSTGSPGASPGTSSTGSPGASPGTSSTGSPGSSPSASTGTGPGTPGSG TASSSPGASPGTSSTGSPGASPGTSSTGSPGASPGTSSTGSPGSSTPSGATGSPGSSTP SGATGSPGASPGTSSTGSPGTPGSGTASSSPGSSTPSGATGSPGSSTPSGATGSPGSS TPSGATGSPGSSPSASTGTGPGASPGTSSTGSPGASPGTSSTGSPGTPGSGTASSSPG ASPGTSSTGSPGASPGTSSTGSPGASPGTSSTGSPGASPGTSSTGSPGTPGSGTASSSP GSSTPSGATGSPGTPGSGTASSSPGSSTPSGATGSPGTPGSGTASSSPGSSTPSGATG SPGSSTPSGATGSPGSSPSASTGTGPGSSPSASTGTGPGASPGTSSTGSPGTPGSGTA SSSPGSSTPSGATGSPGSSPSASTGTGPGSSPSASTGTGPGASPGTSSTGS | 94 |
| AE624 | MAEPAGSPTSTEEGTPGSGTASSSPGSSTPSGATGSPGASPGTSSTGSPGSPAGSPTS TEEGTSESATPESGPGTSTEPSEGSAPGSPAGSPTSTEEGTSTEPSEGSAPGTSTEPSE GSAPGTSESATPESGPGSEPATSGSETPGSEPATSGSETPGSPAGSPTSTEEGTSESAT PESGPGTSTEPSEGSAPGTSTEPSEGSAPGSPAGSPTSTEEGTSTEPSEGSAPGTSTEP SEGSAPGTSESATPESGPGTSTEPSEGSAPGTSESATPESGPGSEPATSGSETPGTSTE PSEGSAPGTSTEPSEGSAPGTSESATPESGPGTSESATPESGPGSPAGSPTSTEEGTSE SATPESGPGSEPATSGSETPGTSESATPESGPGTSTEPSEGSAPGTSTEPSEGSAPGTS TEPSEGSAPGTSTEPSEGSAPGTSTEPSEGSAPGSPAGSPTSTEEGT STEPSEGSAPGTSESATPESGPGSEPATSGSETPGTSESATPESGPGSEPATSGSETPG TSESATPESGPGTSTEPSEGSAPGTSESATPESGPGSPAGSPTSTEEGSPAGSPTSTEE GSPAGSPTSTEEGTSESATPESGPGTSTEPSEGSAP | 95 |
| AD836 | GSSESGSSEGGPGSSESGSSEGGPGESPGGSSGSESGSGGEPSESGSSGESPGGSSGS ESGESPGGSSGSESGSSESGSSEGGPGSSESGSSEGGPGESPGGSS GSESGESPGGSSGSESGSSPGGSSGESGSSESGSSEGGPGSSESGSSEGGPGSSESGS SEGGPGSSESGSSEGGPGSSESGSSEGGPGSSGGEPSESGSSGESPG GSSGSESGESPGGSSGSESGSGGEPSESGSSGSEGSSGPGESSGSSESGSSEGGPGSG GEPSESGSSGSEGSSGPGESSGSSESGSSEGGPGSSGGEPSESGSSGGEPSESGSS GSEGSSGPGESSGESPGGSSGSESGSEGSSGPGESSGSEGSSGPGESSGSGGEPSESG SSGSSESGSSEGGPGSSESGSSEGGPGESPGGSSGSESGSGGEPSESGSSGSEGSSGPG ESSGESPGGSSGSESGSEGSSGPGSSESGSSEGGPGSGGEPSESGSSGSEGSSGPGESS GSESGSGPGESSGGEPGESSGGEPSESGSSGSSGGEPSESGSSGESPGGSSGS ESGESPGGSSGSESGSGGEPSESGSSGSEGSSGPGESSGESPGGSSGSESGSSESGSSE GGPGSSESGSSEGGPGSSGGEPSESGSSGSSESGSSEGGPGESPGGS SGSESGSGGEPSESGSSGSSESGSSEGGPGESPGGSSGSESGSGGEPSESGSSGESPG GSSGSESGSGGEPSESGSS | 96 |
| AE864 | GSPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTST EEGTSESATPESGPGTSTEPSEGSAPGTSTEPSEGSAPGSPAGSPTSTEEGTSTEPSEG SAPGTSTEPSEGSAPGTSESATPESGPGTSTEPSEGSAPGTSESATPESGPGSEPATSG SETPGTSTEPSEGSAPGTSTEPSEGSAPGTSESATPESGPGTSESATPESGPGSPAGSP TSTEEGTSESATPESGPGSEPATSGSETPGTSESATPESGPGTSTEPSEGSAPGTSTEP SEGSAPGTSTEPSEGSAPGTSTEPSEGSAPGTSTEPSEGSAPGTSTEPSEGSAPGSPAG SPTSTEEGTSTEPSEGSAPGTSESATPESGPGSEPATSGSETPGTSESATPESGPGSEP ATSGSETPGTSESATPESGPGTSTEPSEGSAPGTSESATPESGPGSPAGSPTSTEEGSP AGSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAPG SPAGSPTSTEEGTSESATPESGPGSEPATSGSETPGTSESATPESGPGSPAGSPTSTEE GSPAGSPTSTEEGTSTEPSEGSAPGTSESATPESGPGTSESATPESG PGSEPATSGSETPGSEPATSGSETPGSPAGSPTSTEEGTSTEPSEGSAPGTSTEPSEGS APGSEPATSGSETPGTSESATPESGPGTSTEPSEGSAP | 97 |
| AF864 | GSTSESPSGTAPGTSPSGESSTAPGSTSESPSGTAPGSTSESPSGTAPGTSTPESGSAS PGTSTPESGSASPGSTSESPSGTAPGSTSESPSGTAPGTSPSGESSTAPGSTSESPSGT APGTSPSGESSTAPGTSPSGESSTAPGSTSSTAESPGPGTSPSGESSTAPGTSPSGESS TAPGSTSSTAESPGPGTSTPESGSASPGTSTPESGSASPGSTSESPSGTAPGSTSESPS GTAPGTSTPESGSASPGSTSSTAESPGPGTSTPESGSASPGSTSESPSGTAPGTSPSGE | 98 |

TABLE 2-continued

XTEN Polypeptides

| XTEN Name | Amino Acid Sequence | SEQ ID NO: |
|---|---|---|
| | SSTAPGSTSSTAESPGPGTSPSGESSTAPGTSTPESGSASPGSTSSTAESPGPGTSSST AESPGPGTSSTAESPGPGTSSTAESPGPGTSPSGESSTAPGSTSESPSGTAPGSTSE SPSGTAPGTSTPESGPXXXGASASGAPSTXXXXSESPSGTAPGSTSESPSGTAPGSTS ESPSGTAPGSTSESPSGTAPGSTSESPSGTAPGSTSESPSGTAPGTSTPESGSASPGTS PSGESSTAPGTSPSGESSTAPGSTSSTAESPGPGTSPSGESSTAPGTSTPESGSASPGS TSESPSGTAPGSTSESPSGTAPGTSPSGESSTAPGSTSESPSGTAPGTSTPESGSASPG TSTPESGSASPGSTSESPSGTAPGTSTPESGSASPGSTSSTAESPGPGSTSESPSGTAP GSTSESPSGTAPGTSPSGESSTAPGSTSSTAESPGPGTSPSGESSTAPGTSTPESGSAS PGTSPSGESSTAPGTSPSGESSTAPGTSPSGESSTAPGSTSSTAESPGPGTSSTAESP GPGTSPSGESSTAPGSSPSASTGTGPGSSTPSGATGSPGSSTPSGATGSP | |
| AG864_2 | GASPGTSSTGSPGSSPSASTGTGPGSSPSASTGTGPGTPGSGTASSSPGSSTPSGATG SPGSSPSASTGTGPGASPGTSSTGSPGTPGSGTASSSPGSSTPSGATGSPGTPGSGTA SSSPGASPGTSSTGSPGASPGTSSTGSPGTPGSGTASSSPGSSTPSGATGSPGASPGTS STGSPGTPGSGTASSSPGSSTPSGATGSPGSSPSASTGTGPGSSPSASTGTGPGSSTPS GATGSPGSSTPSGATGSPGASPGTSSTGSPGASPGTSSTGSPGASPGTSSTGSPGTPG SGTASSSPGASPGTSSTGSPGASPGTSSTGSPGASPGTSSTGSPGSSPSASTGTGPGTP GSGTASSSPGASPGTSSTGSPGASPGTSSTGSPGASPGTSSTGSPGSSTPSGATGSPGS STPSGATGSPGASPGTSSTGSPGTPGSGTASSSPGSSTPSGATGSPGSSTPSGATGSP GSSTPSGATGSPGSSPSASTGTGPGASPGTSSTGSPGASPGTSSTGSPGTPGSGTASS SPGASPGTSSTGSPGASPGTSSTGSPGASPGTSSTGSPGASPGTSSTGSPGTPGSGTA SSSPGSSTPSGATGSPGTPGSGTASSSPGSSTPSGATGSPGTPGSGTASSSPGSSTPSG ATGSPGSSTPSGATGSPGSSPSASTGTGPGSSPSASTGTGPGASPGTSSTGSPGTPGS GTASSSPGSSTPSGATGSPGSSPSASTGTGPGSSPSASTGTGPGASPGTSSTGSPGASP GTSSTGSPGSSTPSGATGSPGSSPSASTGTGPGASPGTSSTGSPGSSPSASTGTGPGTP GSGTASSSPGSSTPSGATGSPGSSTPSGATGSPGASPGTSSTGSP | 99 |
| AM875 | GTSTEPSEGSAPGSEPATSGSETPGSPAGSPTSTEEGSTSSTAESPGPGTSTPESGSAS PGSTSESPSGTAPGSTSESPSGTAPGTSTPESGSASPGTSTPESGSASPGSEPATSGSE TPGTSESATPESGPGSPAGSPTSTEEGTSTEPSEGSAPGTSESATPESGPGTSTEPSEG SAPGTSTEPSEGSAPGSPAGSPTSTEEGTSTEPSEGSAPGTSTEPSEGSAPGTSESATP ESGPGTSESATPESGPGTSTEPSEGSAPGTSTEPSEGSAPGTSESATPESGPGTSTEPS EGSAPGSEPATSGSETPGSPAGSPTSTEEGSSTPSGATGSPGTPGSGTASSSPGSSTPS GATGSPGTSTEPSEGSAPGTSTEPSEGSAPGSEPATSGSETPGSPAGSPTSTEEGSPA GSPTSTEEGTSTEPSEGSAPGASASGAPSTGGTSESATPESGPGSPAGSPTSTEEGSP AGSPTSTEEGSTSSTAESPGPGSTSESPSGTAPGTSPSGESSTAPGTPGSGTASSSPGS STPSGATGSPGSSPSASTGTGPGSEPATSGSETPGTSESATPESGPGSEPATSGSETPG STSSTAESPGPGSTSSTAESPGPGTSPSGESSTAPGSEPATSGSETPGSEPATSGSETP GTSTEPSEGSAPGSTSSTAESPGPGTSTPESGSASPGSTSESPSGTAPGTSTEPSEGSA PGTSTEPSEGSAPGTSTEPSEGSAPGSSTPSGATGSPGSSPSASTGTGPGASPGTSSTG SPGSEPATSGSETPGTSESATPESGPGSPAGSPTSTEEGSTPSGATGSPGSSPSASTG TGPGASPGTSSTGSPGTSESATPESGPGTSTEPSEGSAPGTSTEPSEGSAP | 100 |
| AM1318 | GTSTEPSEGSAPGSEPATSGSETPGSPAGSPTSTEEGSTSSTAESPGPGTSTPESGSAS PGSTSESPSGTAPGSTSESPSGTAPGTSTPESGSASPGTSTPESGSASPGSEPATSGSE TPGTSESATPESGPGSPAGSPTSTEEGTSTEPSEGSAPGTSESATPESGPGTSTEPSEG SAPGTSTEPSEGSAPGSPAGSPTSTEEGTSTEPSEGSAPGTSESATPESGPGTSTEPSEG SAPGTSTEPSEGSAPGSPAGSPTSTEEGTSTEPSEGSAPGTSTEPSEGSAPGTSESATP ESGPGTSESATPESGPGTSTEPSEGSAPGTSTEPSEGSAPGTSESATPESGPGTSTEPS EGSAPGSEPATSGSETPGSPAGSPTSTEEGSSTPSGATGSPGTPGSGTASSSPGSSTPS GATGSPGTSTEPSEGSAPGTSTEPSEGSAPGSEPATSGSETPGSPAGSPTSTEEGSPA GSPTSTEEGTSTEPSEGSAPGPEPTGPAPSGGSEPATSGSETPGTSESATPESGPGSPA GSPTSTEEGTSESATPESGPGSPAGSPTSTEEGSPAGSPTSTEEGTSESATPESGPGSP AGSPTSTEEGSPAGSPTSTEEGSTSSTAESPGPGSTSESPSGTAPGTSPSGESSTAPGS TSESPSGTAPGSTSESPSGTAPGTSPSGESSTAPGTSTEPSEGSAPGTSESATPESGPG TSESATPESGPGSEPATSGSETPGTSESATPESGPGTSESATPESGPGTSTEPSEGSAP GTSESATPESGPGTSTEPSEGSAPGTSPSGESSTAPGTSPSGESSTAPGTSPSGESSTA PGTSTEPSEGSAPGSPAGSPTSTEEGTSTEPSEGSAPGSSPSASTGTGPGSSTPSGATG SPGSSTPSGATGSPGSSTPSGATGSPGSSTPSGATGSPGASPGTSSTGSPGASASGAP STGGTSPSGESSTAPGSTSSTAESPGPGTSPSGESSTAPGTSESATPESGPGTSTEPSE GSAPGTSTEPSEGSAPGSSPSASTGTGPGSSTPSGATGSPGASPGTSSTGSPGTSTPES GSASPGTSPSGESSTAPGTSPSGESSTAPGTSESATPESGPGSEPATSGSETPGTSTEP SEGSAPGSTSESPSGTAPGSTSESPSGTAPGTSTPESGSASPGSPAGSPTSTEEGTSES ATPESGPGTSTEPSEGSAPGSPAGSPTSTEEGTSESATPESGPGSEPATSGSETPGSST PSGATGSPGASPGTSSTGSPGSSTPSGATGSPGSTSESPSGTAPGTSPSGESSTAPGST SSTAESPGPGSSTPSGATGSPGASPGTSSTGSPGTPGSGTASSSPGSPAGSPTSTEEGS PAGSPTSTEEGTSTEPSEGSAP | 101 |
| BC 864 | GTSTEPSEPGSAGTSTEPSEPGSAGSEPATSGTEPSGSGASEPTSTEPGSEPATSGTE PSGSEPATSGTEPSGSEPATSGTEPSGSGASEPTSTEPGTSTEPSEPGSAGSEPATSG TEPSGTSTEPSEPGSAGSEPATSGTEPSGSEPATSGTEPSGTSEPSTSEPGAGSGASE PGSAGSEPATSGTEPSGSEPATSGTEPSGTSEPSTSEPGAGSGASEPTSTEPGSEPATS GTEPSGSEPATSGTEPSGSEPATSGTEPSGSEPATSGTEPSGSGASEPTSTEPGTSEP STSEPGAGSEPATSGTEPSGSEPATSGTEPSGSEPATSGTEPSGSEPATSGTEPSGT STEPSEPGSAGSEPATSGTEPSGSGASEPTSTEPGTSTEPSEPGSAGSEPATSGTEPS GSGASEPTSTEPGTSTEPSEPGSAGSGASEPTSTEPGSEPATSGTEPSGSGASEPTST | 102 |

TABLE 2-continued

XTEN Polypeptides

| XTEN Name | Amino Acid Sequence | SEQ ID NO: |
|---|---|---|
| | EPGSEPATSGTEPSGSGASEPTSTEPGTSTEPSEPGSAGSEPATSGTEPSGSGASEPT STEPGTSTEPSEPGSAGSEPATSGTEPSGTSTEPSEPGSAGSEPATSGTEPSGTSTEPS EPGSAGTSTEPSEPGSAGTSTEPSEPGSAGTSTEPSEPGSAGTSTEPSEPGSAGTSTE PSEPGSAGTSEPSTSEPGAGSGASEPTSTEPGTSTEPSEPGSAGTSTEPSEPGSAGTS TEPSEPGSAGSEPATSGTEPSGSGASEPTSTEPGSEPATSGTEPSGSEPATSGTEPSG SEPATSGTEPSGSEPATSGTEPSGTSEPSTSEPGAGSEPATSGTEPSGSGASEPTSTEP GTSTEPSEPGSAGSEPATSGTEPSGSGASEPTSTEPGTSTEPSEPGSA | |
| BD864 | GSETATSGSETAGTSESATSESGAGSTAGSETSTEAGTSESATSESGAGSETATSGS ETAGSETATSGSETAGTSTEASEGSASGTSTEASEGSASGTSESATSESGAGSETAT SGSETAGTSTEASEGSASGSTAGSETSTEAGTSESATSESGAGTSESATSESGAGSE TATSGSETAGTSESATSESGAGTSTEASEGSASGSETATSGSETAGSETATSGSETA GTSTEASEGSASGSTAGSETSTEAGTSESATSESGAGTSTEASEGSASGSETATSGS ETAGSTAGSETSTEAGSTAGSETSTEAGSETATSGSETAGTSESATSESGAGTSESA TSESGAGSETATSGSETAGTSESATSESGAGTSESATSESGAGSETATSGSETAGSE TATSGSETAGTSTEASEGSASGSTAGSETSTEAGSETATSGSETAGTSESATSESGA GSTAGSETSTEAGSTAGSETSTEAGSTAGSETSTEAGTSTEASEGSASGSTAGSETS TEAGSTAGSETSTEAGTSTEASEGSASGSTAGSETSTEAGSETATSGSETAGTSTEA SEGSASGTSESATSESGAGSETATSGSETAGTSESATSESGAGTSESATSESGAGSE TATSGSETAGTSESATSESGAGSETATSGSETAGTSTEASEGSASGTSTEASEGSAS GSTAGSETSTEAGSTAGSETSTEAGSETATSGSETAGTSESATSESGAGTSESATSE SGAGSETATSGSETAGSETATSGSETAGSETATSGSETAGTSTEASEGSASGTSESA TSESGAGSETATSGSETAGSETATSGSETAGTSESATSESGAGTSESATSESGAGSE TATSGSETA | 103 |
| AE948 | GTSTEPSEGSAPGTSESATPESGPGSEPATSGSETPGTSESATPESGPGTSTEPSEGSA PGSPAGSPTSEEGTSTEPSEGSAPGSEPATSGSETPGTSESATPESGPGTSESATPES GPGSEPATSGSETPGTSTEPSEGSAPGTSESATPESGPGTSTEPSEGSAPGTSTEPSEG SAPGSEPATSGSETPGTSTEPSEGSAPGSEPATSGSETPGSEPATSGSETPGTSTEPSE GSAPGSEPATSGSETPGSEPATSGSETPGTSTEPSEGSAPGSEPATSGSETPGSPAGSP TSEEGTSESATPESGPGTSTEPSEGSAPGSEPATSGSETPGTSESATPESGPGSEPAT SGSETPGSEPATSGSETPGTSESATPESGPGSPAGSPTSEEGTSESATPESGPGSPAG SPTSEEGTSTEPSEGSAPGTSESATPESGPGTSTEPSEGSAPGSPAGSPTSTEEGTSTEPSEGSAPGTSTEPSEGSAPGTSESATPESGPGSPAGSPTSEEGSPAGSPTSEEGTS ESATPESGPGTSESATPESGPGTSTEPSEGSAPGSPAGSPTSEEGTSESATPESGPGT STEPSEGSAPGSEPATSGSETPGSPAGSPTSEEGTSESATPESGPGTSTEPSEGSAPG SEPATSGSETPGSEPATSGSETPGSEPATSGSETPGSPAGSPTSEEGTSESATPESGP GSEPATSGSETPGSEPATSGSETPGSPAGSPTSEEGSPAGSPTSEEGSPAGSPTSTE EGTSESATPESGPGSEPATSGSETPGTSTEPSEGSAPGTSTEPSEGSAPGSPAGSPTST EEGSPAGSPTSTEEGSPAGSPTSTEEGTSTEPSEGSAPGTSESATPESGPGTSESATPE SGPGTSTEPSEGSAPGTSTEPSEGSAPGTSTEPSEGSAPGTSESATPESGPGTSESATP ESGP | 104 |
| AE1044 | GSEPATSGSETPGSEPATSGSETPGTSTEPSEGSAPGTSESATPESGPGSPAGSPTSTE EGTSTEPSEGSAPGTSESATPESGPGTSESATPESGPGSEPATSGSETPGSEPATSGSE TPGTSESATPESGPGTSESATPESGPGSPAGSPTSEEGTSTEPSEGSAPGSEPATSGS ETPGTSTEPSEGSAPGSPAGSPTSEEGSPAGSPTSEEGSPAGSPTSEEGTSTEPSE GSAPGTSESATPESGPGSEPATSGSETPGTSESATPESGPGTSESATPESGPGSPAGSP TSEEGTSTEPSEGSAPGSEPATSGSETPGTSTEPSEGSAPGTSESATPESGPGSPAGS PTSEEGTSTEPSEGSAPGTSTEPSEGSAPGSPAGSPTSEEGTSTEPSEGSAPGTSES ATPESGPGSPAGSPTSEEGTSESATPESGPGSEPATSGSETPGTSTEPSEGSAPGSEP ATSGSETPGTSESATPESGPGTSTEPSEGSAPGTSESATPESGPGTSTEPSEGSAPGTS TEPSEGSAPGSEPATSGSETPGSPAGSPTSEEGTSESATPESGPGTSTEPSEGSAPGS PAGSPTSEEGTSTEPSEGSAPGTSESATPESGPGTSTEPSEGSAPGSEPATSGSETPG SEPATSGSETPGTSESATPESGPGTSESATPESGPGTSESATPESGPGTSTEPSEGSAP GTSTEPSEGSAPGSPAGSPTSEEGSPAGSPTSEEGTSESATPESGPGSPAGSPTSTE EGSPAGSPTSEEGTSESATPESGPGSEPATSGSETPGTSTEPSEGSAPGSEPATSGSE TPGSPAGSPTSEEGTSESATPESGPGTSESATPESGPGSEPATSGSETPGTSTEPSEG SAPGTSTEPSEGSAPGSPAGSPTSEEGTSTEPSEGSAPGTSTEPSEGSAPGSEPATSG SETPGSPAGSPTSEEGTSESATPESGPGTSESATPESGPGSPAGSPTSEEGTSESAT PESGPGTSESATPESGPGTST | 105 |
| AE1140 | GSEPATSGSETPGSEPATSGSETPGTSTEPSEGSAPGSEPATSGSETPGTSESATPESG PGSEPATSGSETPGSPAGSPTSEEGTSESATPESGPGSEPATSGSETPGTSTEPSEGS APGTSESATPESGPGTSESATPESGPGTSTEPSEGSAPGTSTEPSEGSAPGSEPATSGS ETPGSPAGSPTSEEGTSTEPSEGSAPGSEPATSGSETPGSPAGSPTSEEGTSTEPSE GSAPGTSESATPESGPGSPAGSPTSEEGTSTEPSEGSAPGTSESATPESGPGSEPATS GSETPGTSESATPESGPGSEPATSGSETPGTSTEPSEGSAPGTSTEPSEGSAPGTSTEP SEGSAPGSPAGSPTSEEGSPAGSPTSEEGTSESATPESGPGTSTEPSEGSAPGTSTE PSEGSAPGSPAGSPTSEEGSPAGSPTSEEGTSESATPESGPGSE ATSGSETPGTSESATPESGPGSPAGSPTSEEGTSTEPSEGSAPGTSESATPESGPGSE PATSGSETPGSPAGSPTSEEGTSTEPSEGSAPGTSESATPESGPGTSESATPESGPGS PAGSPTSEEGTSTEPSEGSAPGSPAGSPTSEEGSPAGSPTSEEGTSESATPESGPG SEPATSGSETPGTSTEPSEGSAPGSEPATSGSETPGTSESATPESGPGTSTEPSEGSAP GTSESATPESGPGTSESATPESGPGTSTEPSEGSAPGTSTEPSEGSAPGSEPATSGSET | 106 |

TABLE 2-continued

XTEN Polypeptides

| XTEN Name | Amino Acid Sequence | SEQ ID NO: |
|---|---|---|
| | PGTSESATPESGPGTSTEPSEGSAPGSEPATSGSETPGSPAGSPTSTEEGTSESATPES<br>GPGSPAGSPTSTEEGTSTEPSEGSAPGSEPATSGSETPGSEPATSGSETPGSEPATSGS<br>ETPGTSESATPESGPGTSESATPESGPGTSTEPSEGSAPGTSTEPSEGSAPGSEPATSG<br>SETPGTSTEPSEGSAPGTSESATPESGPGTSESATPESGPGTSTEPSEGSAPGSEPATSG<br>EGSAPGSPAGSPTSTEEGSPA | |
| AE1236 | GSPAGSPTSTEEGTSTEPSEGSAPGSPAGSPTSTEEGTSESATPESGPGSEPATSGSET<br>PGTSTEPSEGSAPGTSTEPSEGSAPGTSESATPESGPGTSTEPSEGSAPGTSTEPSEGS<br>APGSEPATSGSETPGSPAGSPTSTEEGTSESATPESGPGSPAGSPTSTEEGTSTEPSEG<br>SAPGSPAGSPTSTEEGTSTEPSEGSAPGSPAGSPTSTEEGTSTEPSEGSAPGSPAGSPT<br>STEEGSPAGSPTSTEEGTSTEPSEGSAPGSEPATSGSETPGSPAGSPTSTEEGTSESAT<br>PESGPGSEPATSGSETPGSEPATSGSETPGTSESATPESGPGSPAGSPTSTEEGTSESA<br>TPESGPGSEPATSGSETPGSEPATSGSETPGTSESATPESGPGTSESATPESGPGTSTE<br>PSEGSAPGTSTEPSEGSAPGTSESATPESGPGSPAGSPTSTEEGTSTEPSEGSAPGSEP<br>ATSGSETPGSPAGSPTSTEEGTSTEPSEGSAPGTSTEPSEGSAPGSPAGSPTSTEEGSP<br>AGSPTSTEEGSPAGSPTSTEEGTSESATPESGPGSEPATSGSETPGTSESATPESGPGT<br>SESATPESGPGTSTEPSEGSAPGTSESATPESGPGSPAGSPTSTEEGTSESATPESGPG<br>TSESATPESGPGTSTEPSEGSAPGSEPATSGSETPGTSTEPSEGSAPGSPAGSPTSTEE<br>GTSESATPESGPGTSTEPSEGSAPGTSTEPSEGSAPGSEPATSGSETPGSEPATSGSET<br>PGTSESATPESGPGSEPATSGSETPGSPAGSPTSTEEGTSESATPESGPGSEPATSGSE<br>TPGTSTEPSEGSAPGTSESATPESGPGTSESATPESGPGTSTEPSEGSAPGSEPATSGS<br>ETPGTSTEPSEGSAPGSPAGSPTSTEEGSPAGSPTSTEEGTSESATPESGPGSEPATSG<br>SETPGSPAGSPTSTEEGSPAGSPTSTEEGTSESATPESGPGSEPATSGSETPGTSTEPS<br>EGSAPGTSTEPSEGSAPGSEP | 107 |
| AE1332 | GSPAGSPTSTEEGTSTEPSEGSAPGTSESATPESGPGTSESATPESGPGSEPATSGSET<br>PGTSTEPSEGSAPGTSESATPESGPGSPAGSPTSTEEGTSTEPSEGSAPGTSESATPES<br>GPGSPAGSPTSTEEGTSTEPSEGSAPGTSESATPESGPGTSTEPSEGSAPGSEPATSGS<br>ETPGSEPATSGSETPGSEPATSGSETPGTSESATPESGPGSPAGSPTSTEEGTSESATP<br>ESGPGSEPATSGSETPGTSESATPESGPGTSESATPESGPGSPAGSPTSTEEGTSTEPS<br>EGSAPGTSESATPESGPGTSTEPSEGSAPGTSTEPSEGSAPGTSTEPSEGSAPGSEPAT<br>SGSETPGTSTEPSEGSAPGTSESATPESGPGTSESATPESGPGTSTEPSEGSAPGTSES<br>ATPESGPGTSESATPESGPGSEPATSGSETPGTSTEPSEGSAPGTSESATPESGPGSPA<br>GSPTSTEEGSPAGSPTSTEEGTSTEPSEGSAPGSEPATSGSETPGSEPATSGSETPGTS<br>TEPSEGSAPGSEPATSGSETPGSPAGSPTSTEEGTSESATPESGPGSEPATSGSETPGS<br>EPATSGSETPGTSESATPESGPGTSESATPESGPGTSTEPSEGSAPGSPAGSPTSTEEG<br>TSESATPESGPGTSTEPSEGSAPGSEPATSGSETPGSPAGSPTSTEEGTSTEPSEGSAP<br>GTSTEPSEGSAPGSEPATSGSETPGTSESATPESGPGTSTEPSEGSAPGSPAGSPTSTE<br>EGTSESATPESGPGTSESATPESGPGTSTEPSEGSAPGSEPATSGSETPGSEPATSGSE<br>TPGTSTEPSEGSAPGTSESATPESGPGSPAGSPTSTEEGTSTEPSEGSAPGTSTEPSEG<br>SAPGSPAGSPTSTEEGSPAGSPTSTEEGTSTEPSEGSAPGSEPATSGSETPGSPAGSPT<br>STEEGTSESATPESGPGSEPATSGSETPGSEPATSGSETPGTSESATPESGPGTSESAT<br>PESGPGTSTEPSEGSAPGTST | 108 |
| AE1428 | GSEPATSGSETPGSPAGSPTSTEEGTSTEPSEGSAPGSEPATSGSETPGTSESATPESG<br>PGTSTEPSEGSAPGTSESATPESGPGSPAGSPTSTEEGTSTEPSEGSAPGTSTEPSEGS<br>APGSPAGSPTSTEEGTSTEPSEGSAPGTSESATPESGPGSEPATSGSETPGTSESATPE<br>SGPGSEPATSGSETPGTSTEPSEGSAPGTSTEPSEGSAPGSEPATSGSETPGTSTEPSE<br>GSAPGTSTEPSEGSAPGSPAGSPTSTEEGTSTEPSEGSAPGTSESATPESGPGTSESAT<br>PESGPGTSTEPSEGSAPGTSTEPSEGSAPGSPAGSPTSTEEGSPAGSPTSTEEGTSTEP<br>SEGSAPGSEPATSGSETPGSPAGSPTSTEEGTSTEPSEGSAPGSPAGSPTSTEEGSPAG<br>SPTSTEEGTSESATPESGPGSEPATSGSETPGSEPATSGSETPGTSTEPSEGSAPGSPA<br>GSPTSTEEGSPAGSPTSTEEGTSESATPESGPGSEPATSGSETPGSEPATSGSETPGTS<br>ESATPESGPGSEPATSGSETPGSEPATSGSETPGTSESATPESGPGTSESATPESGPGT<br>SESATPESGPGTSESATPESGPGSPAGSPTSTEEGTSTEPSEGSAPGTSESATPESGPG<br>TSTEPSEGSAPGTSTEPSEGSAPGTSESATPESGPGTSTEPSEGSAPGTSESATPESGP<br>GSPAGSPTSTEEGTSTEPSEGSAPGSEPATSGSETPGTSTEPSEGSAPGSEPATSGSET<br>PGTSTEPSEGSAPGTSTEPSEGSAPGSPAGSPTSTEEGTSESATPESGPGTSTEPSEGS<br>APGSEPATSGSETPGTSESATPESGPGTSESATPESGPGTSESATPESGPGTSTEPSEG<br>SAPGSEPATSGSETPGSPAGSPTSTEEGTSESATPESGPGTSTEPSEGSAPGTSTEPSE<br>GSAPGSPAGSPTSTEEGTSESATPESGPGTSTEPSEGSAPGTSTEPSEGSAPGSPAGSP<br>TSTEEGTSESATPESGPGSPA | 109 |
| AE1524 | GTSTEPSEGSAPGTSTEPSEGSAPGTSTEPSEGSAPGTSTEPSEGSAPGSPAGSPTSTE<br>EGSPAGSPTSTEEGTSESATPESGPGSEPATSGSETPGTSTEPSEGSAPGTSESATPES<br>GPGTSTEPSEGSAPGTSESATPESGPGTSESATPESGPGSPAGSPTSTEEGTSTEPSEG<br>SAPGSEPATSGSETPGTSTEPSEGSAPGSPAGSPTSTEEGTSTEPSEGSAPGSPAGSPT<br>STEEGSPAGSPTSTEEGSPAGSPTSTEEGTSESATPESGPGSEPATSGSETPGTSESAT<br>PESGPGTSESATPESGPGSPAGSPTSTEEGTSTEPSEGSAPGSEPATSGSETPGTSTEP<br>SEGSAPGSPAGSPTSTEEGSPAGSPTSTEEGSAPGSEPATSGSETPGSPAG<br>SPTSTEEGTSESATPESGPGSEPATSGSETPGSPAGSPTSTEEGTSESATPESGPGTSE<br>SATPESGPGTSTEPSEGSAPGSEPATSGSETPGSEPATSGSETPGTSESATPESGPGSE<br>PATSGSETPGTSTEPSEGSAPGSPAGSPTSTEEGTSTEPSEGSAPGSEPATSGSETPGS<br>EPATSGSETPGSPAGSPTSTEEGTSESATPESGPGTSTEPSEGSAPGSPAGSPTSTEEG<br>SPAGSPTSTEEGTSESATPESGPGSPAGSPTSTEEGTSTEPSEGSAPGSEPATSGSETP | 110 |

TABLE 2-continued

XTEN Polypeptides

| XTEN Name | Amino Acid Sequence | SEQ ID NO: |
|---|---|---|
| | GSEPATSGSETPGSEPATSGSETPGTSESATPESGPGTSESATPESGPGTSTEPSEGSA PGTSTEPSEGSAPGSEPATSGSETPGTSTEPSEGSAPGTSESATPESGPGSPAGSPTST EEGSPAGSPTSTEEGTSTEPSEGSAPGTSESATPESGPGSPAGSPTSTEEGTSTEPSEG SAPGSEPATSGSETPGTSESATPESGPGSEPATSGSETPGTSESATPESGPGSEPATSG SETPGSEPATSGSETPGTSTEPSEGSAPGTSESATPESGPGTSTEPSEGSAPGTSTEPS EGSAPGTSESATPESGPGSPA | |
| AE1620 | GSEPATSGSETPGTSTEPSEGSAPGSEPATSGSETPGTSTEPSEGSAPGTSESATPESG PGTSESATPESGPGSEPATSGSETPGTSTEPSEGSAPGTSTEPSEGSAPGTSESATPES GPGTSTEPSEGSAPGTSTEPSEGSAPGSEPATSGSETPGSPAGSPTSTEEGTSESATPE SGPGTSESATPESGPGTSTEPSEGSAPGTSESATPESGPGSEPATSGSETPGTSESATP ESGPGTSESATPESGPGTSTEPSEGSAPGTSTEPSEGSAPGSEPATSGSETPGSPAGSP TSTEEGTSESATPESGPGSEPATSGSETPGSEPATSGSETPGTSESATPESGPGTSESA TPESGPGSPAGSPTSTEEGTSTEPSEGSAPGTSESATPESGPGTSTEPSEGSAPGTSTE PSEGSAPGTSESATPESGPGTSTEPSEGSAPGSPAGSPTSTEEGSPAGSPTSTEEGTSE SATPESGPGSEPATSGSETPGSEPATSGSETPGTSTEPSEGSAPGTSESATPESGPGSP AGSPTSTEEGSPAGSPTSTEEGTSTEPSEGSAPGSPAGSPTSTEEGSPAGSPTSTEEGT SESATPESGPGSEPATSGSETPGTSTEPSEGSAPGTSTEPSEGSAPGSEPATSGSETPG SPAGSPTSTEEGTSESATPESGPGSPAGSPTSTEEGTSTEPSEGSAPGTSESATPESGP GSEPATSGSETPGTSESATPESGPGTSESATPESGPGSPAGSPTSTEEGTSTEPSEGSA PGSEPATSGSETPGSPAGSPTSTEEGTSTEPSEGSAPGSEPATSGSETPGSEPATSGSE TPGTSESATPESGPGTSESATPESGPGTSTEPSEGSAPGTSESATPESGPGSEPATSGS ETPGTSESATPESGPGTSESATPESGPGTSTEPSEGSAPGTSESATPESGPGSEPATSG SETPGTSTEPSEGSAPGSPAGSPTSTEEGTSESATPESGPGTSTEPSEGSAPGTSTEPS EGSAPGSPAGSPTSTEEGTST | 111 |
| AE1716 | GTSESATPESGPGTSTEPSEGSAPGTSESATPESGPGTSTEPSEGSAPGSEPATSGSET PGSPAGSPTSTEEGTSESATPESGPGSEPATSGSETPGSEPATSGSETPGTSESATPES GPGTSESATPESGPGTSTEPSEGSAPGSEPATSGSETPGSEPATSGSETPGTSESATPE SGPGTSESATPESGPGSEPATSGSETPGTSESATPESGPGSPAGSPTSTEEGSPAGSPT STEEGTSTEPSEGSAPGSEPATSGSETPGSPAGSPTSTEEGTSESATPESGPGSPAGSP TSTEEGTSTEPSEGSAPGSEPATSGSETPGSPAGSPTSTEEGTSESATPESGPGSPAGS PTSTEEGSPAGSPTSTEEGTSTEPSEGSAPGSEPATSGSETPGSPAGSPTSTEEGTSES ATPESGPGTSTEPSEGSAPGSPAGSPTSTEEGTSESATPESGPGSEPATSGSETPGTST EPSEGSAPGSPAGSPTSTEEGTSTEPSEGSAPGTSESATPESGPGTSESATPESGPGTS TEPSEGSAPGTSTEPSEGSAPGSEPATSGSETPGTSESATPESGPGTSESATPESGPGT STEPSEGSAPGTSTEPSEGSAPGSPAGSPTSTEEGSPAGSPTSTEEGTSTEPSEGSAPG SEPATSGSETPGSEPATSGSETPGTSESATPESGPGSPAGSPTSTEEGTSESATPESGP GTSTEPSEGSAPGTSTEPSEGSAPGSPAGSPTSTEEGSPAGSPTSTEEGTSESATPESG PGSPAGSPTSTEEGTSTEPSEGSAPGSEPATSGSETPGSPAGSPTSTEEGSPAGSPTST EEGTSTEPSEGSAPGTSESATPESGPGTSESATPESGPGSPAGSPTSTEEGTSTEPSEG SAPGSPAGSPTSTEEGTSTEPSEGSAPGSPAGSPTSTEEGTSTEPSEGSAPGTSTEPSE GSAPGSEPATSGSETPGSPAGSPTSTEEGTSESATPESGPGSEPATSGSETPGSPAGSP TSTEEGTSESATPESGPGTSE | 112 |
| AE1812 | GTSESATPESGPGSPAGSPTSTEEGSPAGSPTSTEEGTSESATPESGPGSEPATSGSET PGTSTEPSEGSAPGTSTEPSEGSAPGTSTEPSEGSAPGSPAGSPTSTEEGTSTEPSEGS APGTSESATPESGPGTSESATPESGPGSPAGSPTSTEEGSPAGSPTSTEEGSPAGSPTS TEEGTSESATPESGPGSEPATSGSETPGTSESATPESGPGTSTEPSEGSAPGTSESATP ESGPGTSTEPSEGSAPGTSTEPSEGSAPGTSESATPESGPGSPAGSPTSTEEGTSESAT PESGPGTSTEPSEGSAPGSPAGSPTSTEEGTSESATPESGPGSEPATSGSETPGTSTEP SEGSAPGSEPATSGSETPGSEPATSGSETPGTSESATPESGPGTSESATPESGPGTSTE PSEGSAPGTSESATPESGPGSPAGSPTSTEEGTSTEPSEGSAPGSEPATSGSETPGTSE SATPESGPGSEPATSGSETPGTSTEPSEGSAPGTSESATPESGPGSPAGSPTSTEEGSP AGSPTSTEEGSPAGSPTSTEEGTSESATPESGPGSEPATSGSETPGTSESATPESGPGT SESATPESGPGSEPATSGSETPGTSTEPSEGSAPGTSTEPSEGSAPGTSTEPSEGSAPG TSESATPESGPGSEPATSGSETPGTSESATPESGPGSEPATSGSETPGTSTEPSEGSAP GSEPATSGSETPGSPAGSPTSTEEGTSESATPESGPGTSESATPESGPGTSTEPSEGSA PGSPAGSPTSTEEGTSTEPSEGSAPGTSESATPESGPGTSESATPESGPGTSTEPSEGS APGTSTEPSEGSAPGSPAGSPTSTEEGTSESATPESGPGSEPATSGSETPGTSESATPE SGPGTSESATPESGPGTSTEPSEGSAPGSEPATSGSETPGTSESATPESGPGSPAGSPT STEEGTSTEPSEGSAPGSEPATSGSETPGSPAGSPTSTEEGTSESATPESGPGSPAGSP TSTEEGTSTEPSEGSAPGSEP | 113 |
| AE1908 | GSEPATSGSETPGTSTEPSEGSAPGTSESATPESGPGSEPATSGSETPGTSTEPSEGSA PGSPAGSPTSTEEGTSESATPESGPGSPAGSPTSTEEGTSEPSEGSAPGSEPATSGSE TPGTSTEPSEGSAPGTSESATPESGPGSEPATSGSETPGSEPATSGSETPGTSESATPE SGPGTSTEPSEGSAPGTSESATPESGPGTSESATPESGPGSPAGSPTSTEEGSPAGSPT STEEGTSESATPESGPGTSESATPESGPGTSTEPSEGSAPGTSTEPSEGSAPGSPAGSP TSTEEGTSTEPSEGSAPGSEPATSGSETPGSEPATSGSETPGSEPATSGSETPGSEPAT SGSETPGTSESATPESGPGTSESATPESGPGTSESATPESGPGTSTEPSEGSAPGTSES ATPESGPGTSESATPESGPGTSTEPSEGSAPGSPAGSPTSTEEGTSTEPSEGSAPGSEP ATSGSETPGSPAGSPTSTEEGTSESATPESGPGTSTEPSEGSAPGSEPATSGSETPGTS ESATPESGPGTSESATPESGPGTSTEPSEGSAPGSEPATSGSETPGSPAGSPTSTEEGT SESATPESGPGTSESATPESGPGTSTEPSEGSAPGSEPATSGSETPGSPAGSPTSTEEG | 114 |

TABLE 2-continued

XTEN Polypeptides

| XTEN Name | Amino Acid Sequence | SEQ ID NO: |
|---|---|---|
|  | TSESATPESGPGSEPATSGSETPGTSTEPSEGSAPGSEPATSGSETPGSPAGSPTSTEE<br>GTSESATPESGPGSTEPSEGSAPGSEPATSGSETPGTSESATPESGPGTSESATPESG<br>PGSPAGSPTSTEEGTSTEPSEGSAPGSPAGSPTSTEEGSPAGSPTSTEEGSPAGSPTST<br>EEGTSESATPESGPGSEPATSGSETPGTSTEPSEGSAPGTSTEPSEGSAPGTSESATPE<br>SGPGTSTEPSEGSAPGTSESATPESGPGSEPATSGSETPGTSTEPSEGSAPGTSESATP<br>ESGPGSPAGSPTSTEEGSPAGSPTSTEEGSPAGSPTSTEEGTSESATPESGPGSPAGSP<br>TSTEEGTSESATPESGPGSEP |  |
| AE2004A | GTSTEPSEGSAPGSEPATSGSETPGTSTEPSEGSAPGTSTEPSEGSAPGSEPATSGSET<br>PGSPAGSPTSTEEGSPAGSPTSTEEGTSESATPESGPGSEPATSGSETPGTSTEPSEGS<br>APGTSTEPSEGSAPGSPAGSPTSTEEGTSESATPESGPGTSESATPESGPGSPAGSPTS<br>TEEGTSTEPSEGSAPGTSESATPESGPGTSTEPSEGSAPGSEPATSGSETPGTSESATP<br>ESGPGSEPATSGSETPGTSTEPSEGSAPGTSTEPSEGSAPGSPAGSPTSTEEGSPAGSP<br>TSTEEGTSESATPESGPGSPAGSPTSTEEGTSTEPSEGSAPGSEPATSGSETPGSEPAT<br>SGSETPGSPAGSPTSTEEGTSESATPESGPGTSTEPSEGSAPGSEPATSGSETPGTSES<br>ATPESGPGSEPATSGSETPGSPAGSPTSTEEGTSESATPESGPGTSESATPESGPGSEP<br>ATSGSETPGTSESATPESGPGTSESATPESGPGTSESATPESGPGTSTEPSEGSAPGTS<br>ESATPESGPGSEPATSGSETPGTSTEPSEGSAPGSPAGSPTSTEEGTSTEPSEGSAPGS<br>EPATSGSETPGSPAGSPTSTEEGTSESATPESGPGTSESATPESGPGTSTEPSEGSAPG<br>TSESATPESGPGTSTEPSEGSAPGTSESATPESGPGSEPATSGSETPGTSTEPSEGSAP<br>GTSTEPSEGSAPGSPAGSPTSTEEGSPAGSPTSTEEGTSESATPESGPGTSTEPSEGSA<br>PGTSESATPESGPGSPAGSPTSTEEGSPAGSPTSTEEGSPAGSPTSTEEGTSTEPSEGS<br>APGSPAGSPTSTEEGSPAGSPTSTEEGTSESATPESGPGSEPATSGSETPGSEPATSGS<br>ETPGTSESATPESGPGSEPATSGSETPGTSESATPESGPGTSTEPSEGSAPGTSTEPSE<br>GSAPGSPAGSPTSTEEGTSESATPESGPGSPAGSPTSTEEGTSTEPS<br>EGSAPGTSESATPESGPGTSE | 115 |
| AG948 | GSSTPSGATGSPGTPGSGTASSSPGASPGTSSTGSPGSSPSASTGTGPGTPGSGTASS<br>SPGTPGSGTASSSPGTPGSGTASSSPGSSPSASTGTGPGTPGSGTASSSPGSSPSASTG<br>TGPGSSTPSGATGSPGSSTPSGATGSPGSSPSASTGTGPGSSTPSGATGSPGASPGTS<br>STGSPGASPGTSSTGSPGSSPSASTGTGPGSSPSASTGTGPGASPGTSSTGSPGSSPSA<br>STGTGPGASPGTSSTGSPGSSPSASTGTGPGASPGTSSTGSPGTPGSGTASSSPGTPG<br>SGTASSSPGSSTPSGATGSPGSSTPSGATGSPGSSTPSGASPGTSSTGSPGSS<br>PSASTGTGPGASPGTSSTGSPGASPGTSSTGSPGSSTPSGATGSPGSSPSASTGTGPG<br>SSPSASTGTGPGTPGSGTASSSPGASPGTSSTGSPGTPGSGTASSSPGSSTPSGATGSP<br>GSSTPSGATGSPGSSPSASTGTGPGSSPSASTGTGPGSSTPSGATGSPGASPGTSSTG<br>SPGTPGSGTASSSPGSSPSASTGTGPGSSTPSGATGSPGASPGTSSTGSPGSSTPSGAT<br>GSPGTPGSGTASSSPGSSPSASTGTGPGSSTPSGATGSPGASPGTSSTGSPGASPGTSS<br>TGSPGTPGSGTASSSPGTPGSGTASSSPGSSPSASTGTGPGASPGTSSTGSPGASPGT<br>SSTGSPGTPGSGTASSSPGTPGSGTASSSPGSSTPSGATGSPGSSPSASTGTGPGSSTP<br>SGATGSPGSSPSASTGTGPGSSPSASTGTGPGTPGSGTASSSPGSSTPSGATGSPGAS<br>PGTSSTGSPGTPGSGTASSSPGTPGSGTASSSPGSSTPSGATGSPGTPGSGTASSSPG<br>ASPGTSSTGSPGSSTPSGATGSPGSSTPSGATGSPGTPGSGTASSSPGSSTPSGATGSP<br>GSSTPSGATGSP | 116 |
| AG1044 | GTPGSGTASSSPGTPGSGTASSSPGSSPSASTGTGPGTPGSGTASSSPGASPGTSSTG<br>SPGTPGSGTASSSPGSSPSASTGTGPGSSTPSGATGSPGASPGTSSTGSPGASPGTSST<br>GSPGSSPSASTGTGPGSSTPSGATGSPGSSPSASTGTGPGSSPSASTGTGPGTPGSGT<br>ASSSPGTPGSGTASSSPGASPGTSSTGSPGSSTPSGATGSPGSSPSASTGTGPGTPGSG<br>TASSSPGASPGTSSTGSPGTPGSGTASSSPGSSPSASTGTGPGSSPSASTGTGPGASPG<br>TSSTGSPGASPGTSSTGSPGSSTPSGATGSPGSSTPSGTPGSGTASSSPGSSP<br>SASTGTGPGSSTPSGATGSPGASPGTSSTGSPGSSTPSGATGSPGSSTPSGATGSPGS<br>SPSASTGTGPGASPGTSSTGSPGTPGSGTASSSPGASPGTSSTGSPGSSTPSGATGSP<br>GTPGSGTASSSPGSSTPSGATGSPGASPGTSSTGSPGTPGSGTASSSPGTPGSGTASS<br>SPGSSTPSGATGSPGASPGTSSTGSPGTPGSGTASSSPGTPGSGTASSSPGSSTPSGAT<br>GSPGSSTPSGATGSPGTPGSGTASSSPGSSTPSGATGSPGSSTPSGATGSPGASPGTSS<br>TGSPGSSPSASTGTGPGSSPSASTGTGPGASPGTSSTGSPGASPGTSSTGSPGTPGSG<br>TASSSPGSSPSASTGTGPGTPGSGTASSSPGSSTPSGATGSPGASPG<br>TSSTGSPGSSPSASTGTGPGASPGTSSTGSPGSSPSASTGTGPGASP<br>GTSSTGSPGASPGTSSTGSPGSSTPSGATGSPGASPGTSSTGSPGASPGTSSTGSPGTP<br>GSGTASSSPGTPGSGTASSSPGTPGSGTASSSPGSSTPSGATGSPGSSTPSGATGSPGS<br>SPSASTGTGPGSSPSASTGTGPGTPGSGTASSSPGSSPSASTGTGPGASPGTSSTGSP<br>GSSTPSGATGSPGTPGSGTASSSPGSST | 117 |
| AG1140 | GASPGTSSTGSPGSSPSASTGTGPGSSTPSGATGSPGASPGTSSTGSPGASPGTSSTG<br>SPGSSTPSGATGSPGTPGSGTASSSPGASPGTSSTGSPGTPGSGTASSSPGTPGSGTA<br>SSSPGSSTPSGATGSPGSSTPSGATGSPGTPGSGTASSSPGSSTPSGATGSPGSSTPSG<br>ATGSPGSSPSASTGTGPGSSPSASTGTGPGASPGTSSTGSPGTPGSGTASSSPGASPG<br>TSSTGSPGSSTPSGATGSPGTPGSGTASSSPGSSPSASTGTGPGSSTPSGATGSPGSSP<br>SASTGTGPGSSTPSGATGSPGASPGTSSTGSPGSSPSASTGTGPGTPGSGTASSSPG<br>SPGTSSTGSPGSSTPSGATGSPGASPGTSSTGSPGSSPSASTGTGPGTPGSGTASSSPG<br>TPGSGTASSSPGASPGTSSTGSPGTPGSGTASSSPGTPGSGTASSSPGSSPSASTGTGP<br>GASPGTSSTGSPGSSTPSGATGSPGASPGTSSTGSPGSSPSASTGTGPGTPGSGTASS<br>SPGSSPSASTGTGPGSSPSASTGTGPGASPGTSSTGSPGASPGTSSTGSPGTPGSGTA<br>SSSPGASPGTSSTGSPGASPGTSSTGSPGTPGSGTASSSPGTPGSGTASSSPGSSTPSG | 118 |

TABLE 2-continued

XTEN Polypeptides

| XTEN Name | Amino Acid Sequence | SEQ ID NO: |
|---|---|---|
| | ATGSPGSSTPSGATGSPGTPGSGTASSSPGSSPSASTGTGPGTPGSGTASSSPGSSTPS<br>GATGSPGSSTPSGATGSPGASPGTSSTGSPGTPGSGTASSSPGASPGTSSTGSPGSST<br>PSGATGSPGSSTPSGATGSPGTPGSGTASSSPGSSTPSGATGSPGSSTPSGATGSPGA<br>SPGTSSTGSPGSSPSASTGTGPGSSTPSGATGSPGSSTPSGATGSPGSSPSASTGTGPG<br>SSPSASTGTGPGSSTPSGATGSPGASPGTSSTGSPGSSPSASTGTGPGTPGSGTASSSP<br>GASPGTSSTGSPGSSPSASTGTGPGASPGTSSTGSPGSSTPSGATGSPGSSPSASTGT<br>GPGSSPSASTGTGPGASPGTSSTGSPGSST | |
| AG1236 | GSSPSASTGTGPGTPGSGTASSSPGSSPSASTGTGPGSSPSASTGTGPGTPGSGTASS<br>SPGASPGTSSTGSPGSSTPSGATGSPGTPGSGTASSSPGASPGTSSTGSPGTPGSGTA<br>SSSPGTPGSGTASSSPGSSPSASTGTGPGSSPSASTGTGPGSSTPSGATGSPGASPGTS<br>STGSPGSSPSASTGTGPGTPGSGTASSSPGTPGSGTASSSPGSSTPSGATGSPGASPG<br>TSSTGSPGSSPSASTGTGPGTPGSGTASSSPGTPGSGTASSSPGASPGTSSTGSPGSST<br>PSGATGSPGSSTPSGATGSPGSSPSASTGTGPGSSPSASTGTGPGASPGTSSTGSPGSS<br>PSASTGTGPGSSTPSGATGSPGASPGTSSTGSPGASPGTSSTGSPGSSTPSGATGSPG<br>SSPSASTGTGPGASPGTSSTGSPGASPGTSSTGSPGTPGSGTASSSPGSSTPSGATGSP<br>GASPGTSSTGSPGSSTPSGATGSPGTPGSGTASSSPGSSPSASTGTGPGSSTPSGATG<br>SPGTPGSGTASSSPGSSTPSGATGSPGSSTPSGATGSPGASPGTSSTGSPGSSPSASTG<br>TGPGSSPSASTGTGPGASPGTSSTGSPGSSPSASTGTGPGTPGSGTASSSPGTPGSGT<br>ASSSPGASPGTSSTGSPGTPGSGTASSSPGASPGTSSTGSPGTPGSGTASSSPGASPGT<br>SSTGSPGSSTPSGATGSPGASPGTSSTGSPGSSPSASTGTGPGTPGSGTASSSPGTPGS<br>GTASSSPGSSPSASTGTGPGTPGSGTASSSPGASPGTSSTGSPGSSTPSGATGSPGTP<br>GSGTASSSPGASPGTSSTGSPGTPGSGTASSSPGTPGSGTASSSPGSSTPSGATGSPG<br>TPGSGTASSSPGSSPSASTGTGPGSSTPSGATGSPGTPGSGTASSSPGSSTPSGATGSP<br>GSSTPSGATGSPGSSPSASTGTGPGASPGTSSTGSPGTPGSGTASSSPGSSPSASTGT<br>GPGSSPSASTGTGPGASPGTSSTGSPGASP | 119 |
| AG1332 | GSSTPSGATGSPGSSPSASTGTGPGTPGSGTASSSPGSSPSASTGTGPGASPGTSSTG<br>SPGSSPSASTGTGPGTPGSGTASSSPGASPGTSSTGSPGSSTPSGATGSPGSSPSASTG<br>TGPGSSTPSGATGSPGASPGTSSTGSPGTPGSGTASSSPGASPGTSSTGSPGSSTPSG<br>ATGSPGSSTPSGATGSPGSSPSASTGTGPGTPGSGTASSSPGSSTPSGATGSPGSSTPS<br>GATGSPGSSPSASTGTGPGTPGSGTASSSPGASPGTSSTGSPGTPGSGTASSSPGASP<br>GTSSTGSPGASPGTSSTGSPGTPGSGTASSSPGTPGSGTASSSPGSSTPSGATGSPGSS<br>TPSGATGSPGSSTPSGATGSPGASPGTSSTGSPGSSPSASTGTGPGSSTPSGATGSPG<br>SSPSASTGTGPGSSTPSGATGSPGTPGSGTASSSPGSSPSASTGTGPGSSTPSGATGSP<br>GASPGTSSTGSPGASPGTSSTGSPGSSPSASTGTGPGASPGTSSTGSPGSSTPSGATG<br>SPGASPGTSSTGSPGTPGSGTASSSPGTPGSGTASSSPGSSPSASTGTGPGTPGSGTA<br>SSSPGSSTPSGATGSPGSSPSASTGTGPGSSTPSGATGSPGTPGSGTASSSPGTPGSGT<br>ASSSPGSSPSASTGTGPGSSTPSGATGSPGSSTPSGATGSPGSSPSASTGTGPGSSPSA<br>STGTGPGASPGTSSTGSPGASPGTSSTGSPGSSTPSGATGSPGASPGTSSTGSPGSSPS<br>ASTGTGPGTPGSGTASSSPGASPGTSSTGSPGASPGTSSTGSPGTPGSGTASSSPGTP<br>GSGTASSSPGSSPSASTGTGPGTPGSGTASSSPGASPGTSSTGSPGSSTPSGATGSPG<br>TPGSGTASSSPGTPGSGTASSSPGSSTPSGATGSPGSSTPSGATGSPGTPGSGTASSSP<br>GSSPSASTGTGPGSSPSASTGTGPGASPGTSSTGSPGSSPSASTGTGPGSSPSASTGT<br>GPGASPGTSSTGSPGASPGTSSTGSPGTPG | 120 |
| AG1428 | GTPGSGTASSSPGSSTPSGATGSPGASPGTSSTGSPGSSTPSGATGSPGTPGSGTASS<br>SPGTPGSGTASSSPGSSTPSGATGSPGSSTPSGATGSPGASPGTSSTGSPGSSPSASTG<br>TGPGSSTPSGATGSPGASPGTSSTGSPGSSPSASTGTGPGTPGSGTASSSPGASPGTS<br>STGSPGASPGTSSTGSPGTPGSGTASSSPGTPGSGTASSSPGASPGTSSTGSPGASPG<br>TSSTGSPGTPGSGTASSSPGTPGSGTASSSPGSSPSASTGTGPGSSPSASTGTGPGASP<br>GTSSTGSPGSSPSASTGTGPGSSPSASTGTGPGASPGTSSTGSPGASPGTSSTGSPGTP<br>GSGTASSSPGTPGSGTASSSPGSSPSASTGTGPGASPGTSSTGSPGSSTPSGATGSPG<br>ASPGTSSTGSPGSSPSASTGTGPGSSTPSGATGSPGSSPSASTGTGPGSSPSASTGTGP<br>GASPGTSSTGSPGSSPSASTGTGPGSSPSASTGTGPGASPGTSSTGSPGASPGTSSTG<br>SPGSSPSASTGTGPGTPGSGTASSSPGASPGTSSTGSPGSSTPSGATGSPGTPGSGTA<br>SSSPGTPGSGTASSSPGSSPSASTGTGPGSSTPSGATGSPGASPGTSSTGSPGASPGTS<br>STGSPGSSTPSGATGSPGSSPSASTGTGPGASPGTSSTGSPGSSTPSGATGSPGTPGSS<br>GTASSSPGASPGTSSTGSPGTPGSGTASSSPGASPGTSSTGSPGSSTPSGATGSPGSST<br>PSGATGSPGASPGTSSTGSPGSSPSASTGTGPGTPGSGTASSSPGTPGSGTASSSPGSS<br>TPSGATGSPGTPGSGTASSSPGASPGTSSTGSPGSSTPSGATGSPGTPGSGTASSSPG<br>SSPSASTGTGPGSSTPSGATGSPGSSTPSGATGSPGSSPSASTGTGPGSSTPSGATGSP<br>GTPGSGTASSSPGSSPSASTGTGPGTPGSGTASSSPGSSTPSGATGSPGSSPSASTGT<br>GPGSSPSASTGTGPGTPGSGTASSSPGASP | 121 |
| AG1524 | GSSTPSGATGSPGTPGSGTASSSPGTPGSGTASSSPGASPGTSSTGSPGSSTPSGATG<br>SPGTPGSGTASSSPGSSTPSGATGSPGSSPSASTGTGPGSSTPSGATGSPGTPGSGTA<br>SSSPGTPGSGTASSSPGSSPSASTGTGPGSSTPSGATGSPGSSPSASTGTGPGTPGSGT<br>ASSSPGASPGTSSTGSPGSSTPSGATGSPGASPGTSSTGSPGTPGSGTASSSPGSSTPS<br>GATGSPGTPGSGTASSSPGSSPSASTGTGPGASPGTSSTGSPGTPG<br>SGTASSSPGSSTPSGATGSPGSSTPSGATGSPGSSPSASTGTGPGSSPSASTGTGPGAS<br>PGTSSTGSPGTPGSGTASSSPGTPGSGTASSSPGSSPSASTGTGPGASPGTSSTGSPG<br>ASPGTSSTGSPGTPGSGTASSSPGSSPSASTGTGPGASPGTSSTGSPGASPGTSSTGSP<br>GSSTPSGATGSPGSSPSASTGTGPGSSPSASTGTGPGTPGSGTASSSPGTPGSGTASS<br>SPGASPGTSSTGSPGSSTPSGATGSPGTPGSGTASSSPGASPGTSSTGSPGTPGSGTA | 122 |

TABLE 2-continued

XTEN Polypeptides

| XTEN Name | Amino Acid Sequence | SEQ ID NO: |
|---|---|---|
| | SSSPGTPGSGTASSSPGSSTPSGATGSPGSSTPSGATGSPGTPGSGTASSSPGSSPSAS<br>TGTGPGSSTPSGATGSPGSSTPSGATGSPGSSPSASTGTGPGTPGSGTASSSPGSSPS<br>ASTGTGPGASPGTSSTGSPGSSPSASTGTGPGTPGSGTASSSPGASPGTSSTGSPGAS<br>PGTSSTGSPGTPGSGTASSSPGTPGSGTASSSPGSSTPSGATGSPGTPGSGTASSSPG<br>ASPGTSSTGSPGSSTPSGATGSPGSSTPSGATGSPGSSTPSGATGSPGTPGSGTASSSP<br>GSSPSASTGTGPGSSPSASTGTGPGSSPSASTGTGPGASPGTSSTGSPGASPGTSSTG<br>SPGSSPSASTGTGPGTPGSGTASSSPGASPGTSSTGSPGSSTPSGATGSPGASPGTSST<br>GSPGASPGTSSTGSPGSSTPSGATGSPGTPG | |
| AG1620 | GSSTPSGATGSPGSSTPSGATGSPGTPGSGTASSSPGSSPSASTGTGPGTPGSGTASS<br>SPGASPGTSSTGSPGSSTPSGATGSPGASPGTSSTGSPGTPGSGTASSSPGASPGTSST<br>GSPGSSPSASTGTGPGTPGSGTASSSPGASPGTSSTGSPGASPGTSSTGSPGSSPSAST<br>GTGPGSSTPSGATGSPGASPGTSSTGSPGASPGTSSTGSPGASPGTSSTGSPGSSTPS<br>GATGSPGASPGTSSTGSPGTPGSGTASSSPGSSTPSGATGSPGSSTPSGATGSPGSSPS<br>ASTGTGPGSSPSASTGTGPGSSTPSGATGSPGSSPSASTGTGPGSSPSASTGTGPGAS<br>PGTSSTGSPGASPGTSSTGSPGTPGSGTASSSPGSSPSASTGTGPGSSTPSGATGSP<br>ASPGTSSTGSPGSSPSASTGTGPGTPGSGTASSSPGSSPSASTGTGPGSSTPSGATGSP<br>GASPGTSSTGSPGSSTPSGATGSPGTPGSGTASSSPGSSPSASTGTGPGASPGTSSTG<br>SPGSSTPSGATGSPGASPGTSSTGSPGASPGTSSTGSPGTPGSGTASSSPGASPGTSST<br>GSPGASPGTSSTGSPGSSTPSGATGSPGTPGSGTASSSPGSSTPSGATGSPGSSTPSGA<br>TGSPGTPGSGTASSSPGSSTPSGATGSPGSSTPSGATGSPGSSPSASTGTGPGSSPSAS<br>TGTGPGSSTPSGATGSPGASPGTSSTGSPGSSPSASTGTGPGTPGSGTASSSPGASPG<br>TSSTGSPGSSPSASTGTGPGSSTPSGATGSPGSSPSASTGTGPGSSTPSGATGSPGSSP<br>SASTGTGPGTPGSGTASSSPGTPGSGTASSSPGSSTPSGATGSPGSSTPSGATGSPGT<br>PGSGTASSSPGSSPSASTGTGPGSSTPSGATGSPGSSPSASTGTGPGSSPSASTGTGPG<br>SSTPSGATGSPGASPGTSSTGSPGASPGTSSTGSPGTPGSGTASSSPGTPGSGTASSSP<br>GTPGSGTASSSPGSSTPSGATGSPGSST | 123 |
| AG1716 | GASPGTSSTGSPGSSPSASTGTGPGSSTPSGATGSPGSSPSASTGTGPGTPGSGTASS<br>SPGSSTPSGATGSPGSSTPSGATGSPGSSPSASTGTGPGSSTPSGATGSPGTPGSGTA<br>SSSPGSSPSASTGTGPGSSTPSGATGSPGASPGTSSTGSPGSSPSASTGTGPGSSPSAS<br>TGTGPGTPGSGTASSSPGASPGTSSTGSPGSSTPSGATGSPGSSPSASTGTGPGASPG<br>TSSTGSPGSSTPSGATGSPGTPGSGTASSSPGSSPSASTGTGPGSSPSASTGTGPGASPG<br>SASTGTGPGTPGSGTASSSPGTPGSGTASSSPGSSTPSGATGSPGTPGSGTASSSPGS<br>SPSASTGTGPGASPGTSSTGSPGASPGTSSTGSPGTPGSGTASSSPGSSPSASTGTGP<br>GASPGTSSTGSPGTPGSGTASSSPGSSTPSGATGSPGSSTPSGATGSPGASPGTSSTG<br>SPGTPGSGTASSSPGSSPSASTGTGPGTPGSGTASSSPGASPGTSSTGSPGSSTPSGAT<br>GSPGASPGTSSTGSPGASPGTSSTGSPGTPGSGTASSSPGTPGSGTASSSPGSSPSAST<br>GTGPGSSPSASTGTGPGSSPSASTGTGPGTPGSGTASSSPGASPGTSSTGSPGSSTPS<br>GATGSPGASPGTSSTGSPGSSPSASTGTGPGASPGTSSTGSPGSSPSASTGTGPGASP<br>GTSSTGSPGSSPSASTGTGPGSSPSASTGTGPGTPGSGTASSSPGASPGTSSTGSPGTP<br>GSGTASSSPGTPGSGTASSSPGASPGTSSTGSPGSSTPSGATGSPGSSTPSGATGSPGS<br>SPSASTGTGPGSSTPSGATGSPGTPGSGTASSSPGSSPSASTGTGPGSSTPSGATGSP<br>GSSTPSGATGSPGSSPSASTGTGPGSSPSASTGTGPGASPGTSSTGSPGTPGSGTASS<br>SPGSSPSASTGTGPGSSTPSGATGSPGASPGTSSTGSPGASPGTSSTGSPGSSPSASTG<br>TGPGASPGTSSTGSPGASPGTSSTGSPGTPG | 124 |
| AG1812 | GSSTPSGATGSPGSSPSASTGTGPGASPGTSSTGSPGASPGTSSTGSPGTPGSGTASS<br>SPGSSPSASTGTGPGASPGTSSTGSPGSSTPSGATGSPGSSTPSGATGSPGASPGTSST<br>GSPGSSPSASTGTGPGTPGSGTASSSPGTPGSGTASSSPGASPGTSSTGSPGSSTPSGA<br>TGSPGSSTPSGATGSPGSSPSASTGTGPGTPGSGTASSSPGASPGTSSTGSPGSSTPSG<br>ATGSPGTPGSGTASSSPGSSPSASTGTGPGSSTPSGATGSPGTPGSGTASSSPGSSPSA<br>STGTGPGTPGSGTASSSPGASPGTSSTGSPGSSTPSGATGSPGSSTPSGATGSPGTPG<br>SGTASSSPGSSTPSGATGSPGSSTPSGATGSPGASPGTSSTGSPGASPGTSSTGSPGAS<br>PGTSSTGSPGSSTPSGATGSPGTPGSGTASSSPGSSPSASTGTGPGTPGSGTASSSPG<br>ASPGTSSTGSPGTPGSGTASSSPGASPGTSSTGSPGSSTPSGATGSPGSSPSASTGTGP<br>GSSPSASTGTGPGTPGSGTASSSPGASPGTSSTGSPGASPGTSSTGSPGTPGSGTASS<br>SPGASPGTSSTGSPGSSTPSGATGSPGSSTPSGATGSPGSSPSASTGTGPGASPGTSST<br>GSPGASPGTSSTGSPGTPGSGTASSSPGTPGSGTASSSPGSSTPSGATGSPGSSPSAST<br>GTGPGSSPSASTGTGPGASPGTSSTGSPGASPGTSSTGSPGSSTPSGATGSPGSSPSAS<br>TGTGPGASPGTSSTGSPGSSTPSGATGSPGTPGSGTASSSPGSSPSASTGTGPGASPG<br>TSSTGSPGSSTPSGATGSPGTPGSGTASSSPGSSTPSGATGSPGSSTPSGATGSPGSSP<br>SASTGTGPGSSPSASTGTGPGSSTPSGATGSPGSSPSASTGTGPGSS<br>PSASTGTGPGSSTPSGATGSPGASPGTSSTGSPGASPGTSSTGSPGTPGSGTASSSPG<br>ASPGTSSTGSPGSSTPSGATGSPGASP | 125 |
| AG1908 | GSSPSASTGTGPGSSPSASTGTGPGSSPSASTGTGPGTPGSGTASSSPGSSPSASTGT<br>GPGSSPSASTGTGPGASPGTSSTGSPGSSPSASTGTGPGTPGSGTASSSPGTPGSGTA<br>SSSPGASPGTSSTGSPGTPGSGTASSSPGTPGSGTASSSPGSSPSASTGTGPGSSTPSG<br>ATGSPGSSPSASTGTGPGASPGTSSTGSPGSSPSASTGTGPGASPG<br>TSSTGSPGTPGSGTASSSPGTPGSGTASSSPGASPGTSSTGSPGTPGSGTASSSPGTPG<br>SGTASSSPGSSPSASTGTGPGSSTPSGATGSPGASPGTSSTGSPGSSTPSGATGSPGSS<br>PSASTGTGPGSSPSASTGTGPGSSTPSGATGSPGASPGTSSTGSPGSSPSASTGTGPG<br>TPGSGTASSSPGASPGTSSTGSPGASPGTSSTGSPGTPGSGTASSSPGTPGSGTASSSP<br>GSSTPSGATGSPGTPGSGTASSSPGASPGTSSTGSPGSSTPSGATGSPGTPGSGTASS | 126 |

TABLE 2-continued

XTEN Polypeptides

| XTEN Name | Amino Acid Sequence | SEQ ID NO: |
|---|---|---|
|  | SPGSSPSASTGTGPGSSPSASTGTGPGSSTPSGATGSPGASPGTSSTGSPGASPGTSST GSPGTPGSGTASSSPGTPGSGTASSSPGSSTPSGATGSPGSSPSASTGTGPGSSPSAST GTGPGASPGTSSTGSPGASPGTSSTGSPGSSTPSGATGSPGASPGTSSTGSPGASPGT SSTGSPGTPGSGTASSSPGTPGSGTASSSPGTPGSGTASSSPGSSTPSGATGSPGSSTP SGATGSPGSSPSASTGTGPGSSPSASTGTGPGSSTPSGATGSPGTPGSGTASSSPGSSP SASTGTGPGASPGTSSTGSPGSSTPSGATGSPGSSPSASTGTGPGSSTPSGATGSPGA SPGTSSTGSPGSSPSASTGTGPGTPGSGTASSSPGSSPSASTGTGPGSSTPSGATGSPG ASPGTSSTGSPGSSPSASTGTGPGTPGSGTASSSPGSSTPSGATGSPGSSTPSGATGSP GASPGTSSTGSPGSSPSASTGTGPGSSP |  |
| AG2004A | GSSPSASTGTGPGTPGSGTASSSPGSSTPSGATGSPGTPGSGTASSSPGSSTPSGATG SPGSSTPSGATGSPGSSPSASTGTGPGSSPSASTGTGPGTPGSGTA SSSPGASPGTSSTGSPGSSTPSGATGSPGTPGSGTASSSPGTPGSGTASSSPGSSTPSG ATGSPGSSTPSGATGSPGSSPSASTGTGPGASPGTSSTGSPGASPGTSSTGSPGASPG TSSTGSPGASPGTSSTGSPGTPGSGTASSSPGTPGSGTASSSPGSSPSASTGTGPGSST PSGATGSPGASPGTSSTGSPGSSTPSGATGSPGSSTPSGATGSPGSSPSASTGTGPGA SPGTSSTGSPGTPGSGTASSSPGSSPSASTGTGPGASPGTSSTGSPG ASPGTSSTGSPGTPGSGTASSSPGASPGTSSTGSPGTPGSGTASSSPGTPGSGTASSSP GSSTPSGATGSPGTPGSGTASSSPGASPGTSSTGSPGSSTPSGATGSPGSSTPSGATG SPGSSPSASTGTPGSSTPSGATGSPGSSTPSGATGSPGASPGTSSTGSPGSSPSASTG TGPGTPGSGTASSSPGASPGTSSTGSPGSSPSASTGTGPGTPGSGTASSSPGSSPSAST GTGPGTPGSGTASSSPGASPGTSSTGSPGASPGTSSTGSPGTPGSGTASSSPGTPGSG TASSSPGSSTPSGATGSPGSSTPSGATGSPGTPGSGTASSSPGSSTPSGATGSPGSSTP SGATGSPGASPGTSSTGSPGSSPSASTGTGPGSSTPSGATGSPGASPGTSSTGPGSSP SASTGTGPGASPGTSSTGSPGSSTPSGATGSPGASPGTSSTGSPGTPGSGTASSSPGT PGSGTASSSPGSSPSASTGTGPGASPGTSSTGSPGSSTPSGATGSPGSSPSASTGTGPG SSPSASTGTGPGASPGTSSTGSPGTPGSGTASSSPGSSTPSGATGSPGTPGSGTASSSP GSSPSASTGTGPGSSPSASTGTGPGASP | 127 |
| AE72B | SPAGSPTSTEEGSPAGSPTSTEEGTSESATPESGPGTSTEPSEGSAPGTSESATPESGP GSEPATSGSETPG | 128 |
| AE72C | TSESATPESGPGTSESATPESGPGSEPATSGSETPGSEPATSGSETPGSPAGSPTSTEE GTSTEPSEGSAPG | 129 |
| AE108A | TEEGTSESATPESGPGTSTEPSEGSAPGSPAGSPTSTEEGTSTEPSEGSAPGTSTEPSE GSAPGTSESATPESGPGSEPATSGSETPGSEPATSGSETPGSPAGSPTS | 130 |
| AE108B | GSPAGSPTSTEEGTSTEPSEGSAPGTSESATPESGPGTSESATPESG PGSEPATSGSETPGSEPATSGSETPGSPAGSPTSTEEGTSTEPSEGSAP | 131 |
| AE144A | STEPSEGSAPGSPAGSPTSTEEGTSTEPSEGSAPGTSESATPESGPGSEPATSGSETPG TSESATPESGPGSEPATSGSETPGTSESATPESGPGTSTEPSEGSAPGTSESATPESGP GSPAGSPTSTEEGSPAGSPTSTEEGS | 132 |
| AE144B | SEPATSGSETPGTSESATPESGPGSEPATSGSETPGTSESATPESGPGTSTEPSEGSAP GSPAGSPTSTEEGTSESATPESGPGSEPATSGSETPGTSESATPESGPGSPAGSPTSTE EGSPAGSPTSTEEGTSTEPSEGSAPG | 133 |
| AE180A | TSTEEGTSESATPESGPGSEPATSGSETPGTSESATPESGPGSPAGSPTSTEEGSPAGS PTSTEEGTSTEPSEGSAPGTSESATPESGPGTSESATPESGPGTSESATPESGPGSEPA TSGSETPGSEPATSGSETPGSPAGSPTSTEEGTSTEPSEGSAPGTSTEPSEGSAPGSEP ATS | 134 |
| AE216A | PESGPGTSTEPSEGSAPGSPAGSPTSTEEGTSESATPESGPGSEPATSGSETPGTSESA TPESGPGSPAGSPTSTEEGSPAGSPTSTEEGTSTEPSEGSAPGTSESATPESGPGTSES ATPESGPGTSESATPESGPGSEPATSGSETPGSEPATSGSETPGSPAGSPTSTEEGTST EPSEGSAPGTSTEPSEGSAPGSEPATSGSETPGTSESAT | 135 |
| AE252A | ESGPGSEPATSGSETPGTSESATPESGPGTSTEPSEGSAPGSPAGSPTSTEEGTSESAT PESGPGSEPATSGSETPGTSESATPESGPGSPAGSPTSTEEGSPAGSPTSTEEGTSTEP SEGSAPGTSESATPESGPGTSESATPESGPGTSESATPESGPGSEPATSGSETPGSEPA TSGSETPGSPAGSPTSTEEGTSTEPSEGSAPGTSTEPSEGSAPGSEPATSGSETPGTSE SATPESGPGTSTEPSE | 136 |
| AE288A | TPESGPGTSTEPSEGSAPGTSESATPESGPGSEPATSGSETPGTSESATPESGPGSEPA TSGSETPGTSESATPESGPGTSTEPSEGSAPGSPAGSPTSTEEGTSESATPESGPGSEP ATSGSETPGTSESATPESGPGSPAGSPTSTEEGSPAGSPTSTEEGTSTEPSEGSAPGTS ESATPESGPGTSESATPESGPGTSESATPESGPGSEPATSGSETPGSEPATSGSETPGS PAGSPTSTEEGTSTEPSEGSAPGTSTEPSEGSAPGSEPATSGSETPGTSESA | 137 |
| AE324A | PESGPGSPAGSPTSTEEGSPAGSPTSTEEGSPAGSPTSTEEGTSESATPESGPGTSTEP SEGSAPGTSESATPESGPGSEPATSGSETPGTSESATPESGPGSEPATSGSETPGTSES ATPESGPGTSTEPSEGSAPGSPAGSPTSTEEGTSESATPESGPGSEPATSGSETPGTSE SATPESGPGSPAGSPTSTEEGSPAGSPTSTEEGTSTEPSEGSAPGTSESATPESGPGTS | 138 |

TABLE 2-continued

XTEN Polypeptides

| XTEN Name | Amino Acid Sequence | SEQ ID NO: |
|---|---|---|
| | ESATPESGPGTSESATPESGPGSEPATSGSETPGSEPATSGSETPGSPAGSPTSTEEGT<br>STEPSEGSAPGTSTEPSEGSAPGSEPATS | |
| AE360A | PESGPGTSTEPSEGSAPGTSESATPESGPGSPAGSPTSTEEGSPAGSPTSTEEGSPAGS<br>PTSTEEGTSESATPESGPGTSTEPSEGSAPGTSESATPESGPGSEPATSGSETPGTSES<br>ATPESGPGSEPATSGSETPGTSESATPESGPGTSTEPSEGSAPGSPAGSPTSTEEGTSE<br>SATPESGPGSEPATSGSETPGTSESATPESGPGSPAGSPTSTEEGSPAGSPTSTEEGTS<br>TEPSEGSAPGTSESATPESGPGTSESATPESGPGSEPATSGSETPGS<br>EPATSGSETPGSPAGSPTSTEEGTSTEPSEGSAPGTSTEPSEGSAPGSEPATSGSETPG<br>TSESAT | 139 |
| AE396A | PESGPGSEPATSGSETPGTSESATPESGPGTSTEPSEGSAPGTSESATPESGPGSPAGS<br>PTSTEEGSPAGSPTSTEEGSPAGSPTSTEEGTSESATPESGPGTSTEPSEGSAPGTSES<br>ATPESGPGSEPATSGSETPGTSESATPESGPGSEPATSGSETPGTSESATPESGPGTST<br>EPSEGSAPGSPAGSPTSTEEGTSESATPESGPGSEPATSGSETPGTSESATPESGPGSP<br>AGSPTSTEEGSPAGSPTSTEEGTSTEPSEGSAPGTSESATPESGPGTSESATPESGPGT<br>SESATPESGPGSEPATSGSETPGSEPATSGSETPGSPAGSPTSTEEGTSTEPSEGSAPG<br>TSTEPS | 140 |
| AE432A | EGSAPGSPAGSPTSTEEGTSTEPSEGSAPGTSESATPESGPGSEPATSGSETPGTSESA<br>TPESGPGSEPATSGSETPGTSESATPESGPGTSTEPSEGSAPGTSESATPESGPGSPAG<br>SPTSTEEGSPAGSPTSTEEGSPAGSPTSTEEGTSESATPESGPGTSTEPSEGSAPGTSE<br>SATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGTSESATPESGPGS<br>PAGSPTSTEEGSPAGSPTSTEEGTSTEPSEGSAPGTSESATPESGPGTSESATPESGPG<br>TSESATPESGPGSEPATSGSETPGSEPATSGSETPGSPAGSPTSTEEGTSTEPSEGSAP<br>GTSTEPSEGSAPGSEPATS | 141 |
| AE468A | EGSAPGTSTEPSEGSAPGTSTEPSEGSAPGSPAGSPTSTEEGTSTEPSEGSAPGTSESA<br>TPESGPGSEPATSGSETPGTSESATPESGPGSEPATSGSETPGTSESATPESGPGTSTE<br>PSEGSAPGTSESATPESGPGSPAGSPTSTEEGSPAGSPTSTEEGSPAGSPTSTEEGTSE<br>SATPESGPGTSTEPSEGSAPGTSESATPESGPGSEPATSGSETPGTSESATPESGPGSE<br>PATSGSETPGTSESATPESGPGTSTEPSEGSAPGSPAGSPTSTEEGTSESATPESGPGS<br>EPATSGSETPGTSESATPESGPGSPAGSPTSTEEGSPAGSPTSTEEGTSTEPSEGSAPG<br>TSESATPESGPGTSESATPESGPGTSESATPESGPGSEPATSGSETPGSEPATSGSETP<br>GSPAGSPTSTEEGTSTEPSEGSAPGTSTEPSEGSAPGSEPATSGSETPGTSESAT | 142 |
| AE504A | EGSAPGTSTEPSEGSAPGTSTEPSEGSAPGTSTEPSEGSAPGTSTEPSEGSAPGSPAGS<br>PTSTEEGTSTEPSEGSAPGTSESATPESGPGSEPATSGSETPGTSESATPESGPGSEPA<br>TSGSETPGTSESATPESGPGTSTEPSEGSAPGTSESATPESGPGSPAGSPTSTEEGSPA<br>GSPTSTEEGSPAGSPTSTEEGTSESATPESGPGTSTEPSEGSAPGTSESATPESGPGSE<br>PATSGSETPGTSESATPESGPGSEPATSGSETPGTSESATPESGPGTSTEPSEGSAPGS<br>PAGSPTSTEEGTSESATPESGPGSEPATSGSETPGTSESATPESGPGSPAGSPTSTEEG<br>SPAGSPTSTEEGTSTEPSEGSAPGTSESATPESGPGTSESATPESGPGTSESATPESGP<br>GSEPATSGSETPGSEPATSGSETPGSPAGSPTSTEEGTSTEPSEGSAPGTSTEPSEGSA<br>PGSEPATSGSETPGTSESATPESGPGTSTEPS | 143 |
| AE540A | TPESGPGSPAGSPTSTEEGTSESATPESGPGSEPATSGSETPGTSESATPESGPGTSTE<br>PSEGSAPGTSTEPSEGSAPGTSTEPSEGSAPGTSTEPSEGSAPGTST<br>EPSEGSAPGSPAGSPTSTEEGTSTEPSEGSAPGTSESATPESGPGSEPATSGSETPGTS<br>ESATPESGPGSEPATSGSETPGTSESATPESGPGTSTEPSEGSAPGTSESATPESGPGS<br>PAGSPTSTEEGSPAGSPTSTEEGSPAGSPTSTEEGTSESATPESGPGTSTEPSEGSAPG<br>TSESATPESGPGSEPATSGSETPGTSESATPESGPGSEPATSGSETPGTSESATPESGP<br>GTSTEPSEGSAPGSPAGSPTSTEEGTSESATPESGPGSEPATSGSETPGTSESATPESG<br>PGSPAGSPTSTEEGSPAGSPTSTEEGTSTEPSEGSAPGTSESATPESGPGTSESATPES<br>GPGTSESATPESGPGSEPATSGSETPGSEPATSGSETPGSPAGSPTSTEEGTSTEPSEG<br>SAPGTSTEP | 144 |
| AE576A | TPESGPGTSESATPESGPGSPAGSPTSTEEGTSESATPESGPGSEPATSGSETPGTSES<br>ATPESGPGTSTEPSEGSAPGTSTEPSEGSAPGTSTEPSEGSAPGTSTEPSEGSAPGTST<br>EPSEGSAPGTSTEPSEGSAPGSPAGSPTSTEEGTSTEPSEGSAPGTSESATPESGPGSE<br>PATSGSETPGTSESATPESGPGSEPATSGSETPGTSESATPESGPGTSTEPSEGSAPGT<br>SESATPESGPGSPAGSPTSTEEGSPAGSPTSTEEGSPAGSPTSTEEGTSESATPESGPG<br>TSTEPSEGSAPGTSESATPESGPGSEPATSGSETPGTSESATPESGPGSEPATSGSETP<br>GTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPES<br>GPGTSESATPESGPGTSESATPESGPGSEPATSGSETPGSEPATSGSETPGSPAGSPTS<br>TEEGTSTEPSEGSAPGTSTEPSEGSAPGSEPATSGSETPGTSESA | 145 |
| AE612A | GSETPGTSTEPSEGSAPGTSTEPSEGSAPGTSESATPESGPGTSESATPESGPGSPAGS<br>PTSTEEGTSESATPESGPGSEPATSGSETPGTSESATPESGPGTSTEPSEGSAPGTSTE<br>PSEGSAPGTSTEPSEGSAPGTSTEPSEGSAPGTSTEPSEGSAPGTSTEPSEGSAPGSPA<br>GSPTSTEEGTSTEPSEGSAPGTSESATPESGPGSEPATSGSETPGTSESATPESGPGSE<br>PATSGSETPGTSESATPESGPGTSTEPSEGSAPGTSESATPESGPGSPAGSPTSTEEGS<br>PAGSPTSTEEGSPAGSPTSTEEGTSESATPESGPGTSTEPSEGSAPGTSESATPESGPG | 146 |

TABLE 2-continued

XTEN Polypeptides

| XTEN Name | Amino Acid Sequence | SEQ ID NO: |
|---|---|---|
| | SEPATSGSETPGTSESATPESGPGSEPATSGSETPGTSESATPESGPGTSTEPSEGSAP<br>GSPAGSPTSTEEGTSESATPESGPGSEPATSGSETPGTSESATPESGPSPAGSPTSTE<br>EGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEG<br>SAPGSEPATSGSETPGTSESAT | |
| AE648A | PESGPGTSTEPSEGSAPGTSESATPESGPGSEPATSGSETPGTSTEPSEGSAPGTSTEP<br>SEGSAPGTSESATPESGPGTSESATPESGPGSPAGSPTSTEEGTSESATPESGPGSEPA<br>TSGSETPGTSESATPESGPGTSTEPSEGSAPGTSTEPSEGSAPGTSTEPSEGSAPGTST<br>EPSEGSAPGTSTEPSEGSAPGTSTEPSEGSAPGSPAGSPTSTEEGTSTEPSEGSAPGTS<br>ESATPESGPGSEPATSGSETPGTSESATPESGPGSEPATSGSETPGTSESATPESGPGT<br>STEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGP<br>GSEPATSGSETPGTSESATPESGPGTSTEPSEGSAPGSPAGSPTSTEEGTSESATPESG<br>PGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGS<br>ETPGSPAGSPTSTEEGTSTEPSEGSAPGTSTEPSEGSAPGSEPATSGSETPGTSESAT | 147 |
| AE684A | EGSAPGSPAGSPTSTEEGTSTEPSEGSAPGTSTEPSEGSAPGTSESATPESGPGTSTEP<br>SEGSAPGTSESATPESGPGSEPATSGSETPGTSTEPSEGSAPGTSTEPSEGSAPGTSES<br>ATPESGPGTSESATPESGPGSPAGSPTSTEEGTSESATPESGPGSEPATSGSETPGTSE<br>SATPESGPGTSTEPSEGSAPGTSTEPSEGSAPGTSTEPSEGSAPGTSTEPSEGSAPGTS<br>TEPSEGSAPGTSTEPSEGSAPGSPAGSPTSTEEGTSTEPSEGSAPGTSESATPESGPGS<br>EPATSGSETPGTSESATPESGPGSEPATSGSETPGTSESATPESGPGTSTEPSEGSAPG<br>TSESATPESGPGSPAGSPTSTEEGSPAGSPTSTEEGSPAGSPTSTEEGTSESATPESGP<br>GTSTEPSEGSAPGTSESATPESGPGSEPATSGSETPGTSESATPESGPGSEPATSGSET<br>PGTSESATPESGPGTSTEPSEGSAPGSPAGSPTSTEEGTSESATPESGPGSEPATSGSE<br>TPGTSESATPESGPGSPAGSPTSTEEGSPAGSPTSTEEGTSTEPSEGSAPGTSESATPE<br>SGPGTSESATPESGPGSEPATSGSETPGSEPATSGSETPGSPAGSPT<br>STEEGTSTEPSEGSAPGTSTEPSEGSAPGSEPATS | 148 |
| AE720A | TSGSETPGSEPATSGSETPGSPAGSPTSTEEGTSESATPESGPGTSTEPSEGSAPGTST<br>EPSEGSAPGSPAGSPTSTEEGTSTEPSEGSAPGTSTEPSEGSAPGTSESATPESGPGTS<br>TEPSEGSAPGTSESATPESGPGSEPATSGSETPGTSTEPSEGSAPGTSTEPSEGSAPGT<br>SESATPESGPGTSESATPESGPGSPAGSPTSTEEGTSESATPESGPGSEPATSGSETPG<br>TSESATPESGPGTSTEPSEGSAPGTSTEPSEGSAPGTSTEPSEGSAPGTSTEPSEGSAP<br>GTSTEPSEGSAPGTSTEPSEGSAPGSPAGSPTSTEEGTSTEPSEGSAPGTSESATPESG<br>PGSEPATSGSETPGTSESATPESGPGSEPATSGSETPGTSESATPESGPGTSTEPSEGS<br>APGTSESATPESGPGSPAGSPTSTEEGSPAGSPTSTEEGSPAGSPTSTEEGTSESATPE<br>SGPGTSTEPSEGSAPGTSESATPESGPGSEPATSGSETPGTSESATPESGPGSEPATSG<br>SETPGTSESATPESGPGTSTEPSEGSAPGSPAGSPTSTEEGTSESATPESGPGSEPATS<br>GSETPGTSESATPESGPGSPAGSPTSTEEGSPAGSPTSTEEGTSTEPSEGSAPGTSESA<br>TPESGPGTSESATPESGPGTSESATPESGPGSEPATSGSETPGSEPATSGSETPGSPAG<br>SPTSTEEGTSTE | 149 |
| AE756A | TSGSETPGSEPATSGSETPGSPAGSPTSTEEGTSESATPESGPGTSTEPSEGSAPGTST<br>EPSEGSAPGSPAGSPTSTEEGTSTEPSEGSAPGTSTEPSEGSAPGTSESATPESGPGTS<br>TEPSEGSAPGTSESATPESGPGSEPATSGSETPGTSTEPSEGSAPGTSTEPSEGSAPGT<br>SESATPESGPGTSESATPESGPGSPAGSPTSTEEGTSESATPESGPGSEPATSGSETPG<br>TSESATPESGPGTSTEPSEGSAPGTSTEPSEGSAPGTSTEPSEGSAPGTSTEPSEGSAP<br>GTSTEPSEGSAPGTSTEPSEGSAPGSPAGSPTSTEEGTSTEPSEGSAPGTSESATPESG<br>PGSEPATSGSETPGTSESATPESGPGSEPATSGSETPGTSESATPESGPGTSTEPSEGS<br>APGTSESATPESGPGSPAGSPTSTEEGSPAGSPTSTEEGSPAGSPTSTEEGTSESATPE<br>SGPGTSTEPSEGSAPGTSESATPESGPGSEPATSGSETPGTSESATPESGPGSEPATSG<br>SETPGTSESATPESGPGTSTEPSEGSAPGSPAGSPTSTEEGTSESATPESGPGSEPATS<br>GSETPGTSESATPESGPGSPAGSPTSTEEGSPAGSPTSTEEGTSTEPSEGSAPGTSESA<br>TPESGPGTSESATPESGPGTSESATPESGPGSEPATSGSETPGSEPATSGSETPGSPAG<br>SPTSTEEGTSTEPSEGSAPGTSTEPSEGSAPGSEPATSGSETPGTSES | 150 |
| AE792A | EGSAPGTSESATPESGPGSEPATSGSETPGSEPATSGSETPGSPAGSPTSTEEGTSESA<br>TPESGPGTSTEPSEGSAPGTSTEPSEGSAPGSPAGSPTSTEEGTSTEPSEGSAPGTSTE<br>PSEGSAPGTSESATPESGPGTSTEPSEGSAPGTSESATPESGPGSEPATSGSETPGTST<br>EPSEGSAPGTSTEPSEGSAPGTSESATPESGPGTSESATPESGPGSPAGSPTSTEEGTS<br>ESATPESGPGSEPATSGSETPGTSESATPESGPGTSTEPSEGSAPGTSTEPSEGSAPGT<br>STEPSEGSAPGTSTEPSEGSAPGTSTEPSEGSAPGTSTEPSEGSAPGSPAGSPTSTEEG<br>TSTEPSEGSAPGTSESATPESGPGSEPATSGSETPGTSESATPESGPGSEPATSGSETP<br>GTSESATPESGPGTSTEPSEGSAPGTSESATPESGPGSPAGSPTSTEEGSPAGSPTSTE<br>EGSPAGSPTSTEEGTSESATPESGPGTSTEPSEGSAPGTSESATPESGPGSEPATSGSE<br>TPGTSESATPESGPGSEPATSGSETPGTSESATPESGPGTSTEPSEGSAPGSPAGSPTS<br>TEEGTSESATPESGPGSEPATSGSETPGTSESATPESGPGSPAGSPTSTEEGSPAGSPT<br>STEEGTSTEPSEGSAPGTSESATPESGPGTSESATPESGPGTSESATPESGPGSEPATS<br>GSETPGSEPATSGSETPGSPAGSPTSTEEGTSTEPSEGSAPGTSTEPSEGSAPGSEPAT<br>SGSETPGTSESATPESGPGTSTEPS | 151 |

TABLE 2-continued

XTEN Polypeptides

| XTEN Name | Amino Acid Sequence | SEQ ID NO: |
|---|---|---|
| AE828A | PESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGTSESATPESGPGTSTE PSEGSAPGTSTEPSEGSAPGSPAGSPTSTEEGTSTEPSEGSAPGTSTEPSEGSAPGTSE SATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGS EPATSGSETPGTSESATPESGPGTSTEPSEGSAPGTSTEPSEGSAPGTSTEPSEGSAPG TSTEPSEGSAPGTSTEPSEGSAPGTSTEPSEGSAPGSPAGSPTSTEEGTSTEPSEGSAP GTSESATPESGPGSEPATSGSETPGSEPATSGSETPGTSESATPESG PGTSTEPSEGSAPGTSESATPESGPGSPAGSPTSTEEGSPAGSPTSTEEGSPAGSPTST EEGTSESATPESGPGTSTEPSEGSAPGTSESATPESGPGSEPATSGSETPGTSESATPE SGPGSEPATSGSETPGTSESATPESGPGTSTEPSEGSAPGSPAGSPTSTEEGTSESATP ESGPGSEPATSGSETPGTSESATPESGPGSPAGSPTSTEEGSPAGSPTSTEEGTSTEPS EGSAPGTSESATPESGPGTSESATPESGPGTSESATPESGPGSEPATSGSETPGSEPAT SGSETPGSPAGSPTSTEEGTSTEPSEGSAPGTSTEPSEGSAPGSEPATSGSETPGTSES AT | 152 |
| AG72A | GPGSSPSASTGTGPGTPGSGTASSSPGSSTPSGATGSPGSSPSASTGTGPGASPGTSS TGSPGTPGSGTASSS | 153 |
| AG72B | GSSTPSGATGSPGSSTPSGATGSPGSSPSASTGTGPGSSPSASTGTGPGASPGTSSTG SPGTPGSGTASSSP | 154 |
| AG72C | SPSASTGTGPGASPGTSSTGSPGSSPSASTGTGPGTPGSGTASSSPGSSTPSGATGSP GSSTPSGATGSPGA | 155 |
| AG108A | SASTGTGPGSSPSASTGTGPGTPGSGTASSSPGSSTPSGATGSPGSSPSASTGTGPGA SPGTSSTGSPGTPGSGTASSSPGSSTPSGATGSPGTPGSGTASSSPGASP | 156 |
| AG108B | PGTPGSGTASSSPGSSTPSGATGSPGTPGSGTASSSPGSSTPSGATGSPGSSTPSGAT GSPGSSPSASTGTGPGSSPSASTGTGPGASPGTSSTGSPGTPGSGTASSS | 157 |
| AG144A | PGSSPSASTGTGPGSSPSASTGTGPGTPGSGTASSSPGSSTPSGATGSPGSSPSASTGT GPGASPGTSSTGSPGTPGSGTASSSPGSSTPSGATGSPGTPGSGTASSSPGASPGTSS TGSPGASPGTSSTGSPGTPGSGTASSS | 158 |
| AG144B | PSGATGSPGTPGSGTASSSPGSSTPSGATGSPGSSTPSGATGSPGSSPSASTGTGPGSS PSASTGTGPGASPGTSSTGSPGTPGSGTASSSPGSSTPSGATGSPGSSPSASTGTGPG SSPSASTGTGPGASPGTSSTGSPGASP | 159 |
| AG180A | TSSTGSPGSSPSASTGTGPGSSPSASTGTGPGTPGSGTASSSPGSSTPSGATGSPGSSP SASTGTGPGASPGTSSTGSPGTPGSGTASSSPGSSTPSGATGSPGTPGSGTASSSPGA SPGTSSTGSPGASPGTSSTGSPGTPGSGTASSSPGSSTPSGATGSPGASPGTSSTGSPG TPGS | 160 |
| AG216A | TGTGPGSSPSASTGTGPGTPGSGTASSSPGSSTPSGATGSPGSSPSASTGTGPGASPG TSSTGSPGTPGSGTASSSPGSSTPSGATGSPGTPGSGTASSSPGASPGTSSTGSPGASP GTSSTGSPGTPGSGTASSSPGSSTPSGATGSPGASPGTSSTGSPGTPGSGTASSSPGSS TPSGATGSPGSSPSASTGTGPGSSPSASTGTGPGSSTPSG | 161 |
| AG252A | TSSTGSPGSSPSASTGTGPGSSPSASTGTGPGTPGSGTASSSPGSSTPSGATGSPGSSP SASTGTGPGASPGTSSTGSPGTPGSGTASSSPGSSTPSGATGSPGTPGSGTASSSPGA SPGTSSTGSPGASPGTSSTGSPGTPGSGTASSSPGSSTPSGATGSPGASPGTSSTGSPG TPGSGTASSSPGSSTPSGATGSPGSSPSASTGTGPGSSPSASTGTGPGSSTPSGATGSP GSSTPSGATGSPGASPG | 162 |
| AG288A | TSSTGSPGSSPSASTGTGPGSSPSASTGTGPGTPGSGTASSSPGSSTPSGATGSPGSSP SASTGTGPGASPGTSSTGSPGTPGSGTASSSPGSSTPSGATGSPGTPGSGTASSSPGA SPGTSSTGSPGASPGTSSTGSPGTPGSGTASSSPGSSTPSGATGSPGASPGTSSTGSPG TPGSGTASSSPGSSTPSGATGSPGSSPSASTGTGPGSSPSASTGTGPGSSTPSGATGSP GSSTPSGATGSPGASPGTSSTGSPGASPGTSSTGSPGASPGTSSTGSPGTPGS | 163 |
| AG324A | TSSTGSPGTPGSGTASSSPGASPGTSSTGSPGASPGTSSTGSPGASPGTSSTGSPGASP GTSSTGSPGTPGSGTASSSPGSSTPSGATGSPGTPGSGTASSSPGSSTPSGATGSPGTP GSGTASSSPGSSTPSGATGSPGSSTPSGATGSPGSSPSASTGTGPGSSPSASTGTGPG ASPGTSSTGSPGTPGSGTASSSPGSSTPSGATGSPGSSPSASTGTGPGSSPSASTGTGP GASPGTSSTGSPGASPGTSSTGSPGSSTPSGATGSPGSSPSASTGTGPGASPGTSSTG SPGSSPSASTGTGPGTPGSGTASSSPGSSTP | 164 |
| AG360A | TSSTGSPGASPGTSSTGSPGTPGSGTASSSPGASPGTSSTGSPGASPGTSSTGSPGASP GTSSTGSPGASPGTSSTGSPGTPGSGTASSSPGSSTPSGATGSPGTPGSGTASSSPGSS TPSGATGSPGTPGSGTASSSPGSSTPSGATGSPGSSTPSGATGSPGSSPSASTGTGPG SSPSASTGTGPGASPGTSSTGSPGTPGSGTASSSPGSSTPSGATGSPGSSPSASTGTGP GSSPSASTGTGPGASPGTSSTGSPGASPGTSSTGSPGSSTPSGATGSPGSSPSASTGT GPGASPGTSSTGSPGSSPSASTGTGPGTPGSGTASSSPGSSTPSGATGSPGSSTPSGA TGSPGASPG | 165 |

TABLE 2-continued

XTEN Polypeptides

| XTEN Name | Amino Acid Sequence | SEQ ID NO: |
|---|---|---|
| AG396A | GATGSPGSSTPSGATGSPGSSPSASTGTGPGASPGTSSTGSPGASPGTSSTGSPGTPG SGTASSSPGASPGTSSTGSPGASPGTSSTGSPGASPGTSSTGSPGTP GSGTASSSPGSSTPSGATGSPGPTPGSGTASSSPGSSTPSGATGSPGPTPGSGTASSSPGSS TPSGATGSPGSSTPSGATGSPGSSPSASTGTGPGSSPSASTGTGPGASPGTSSTGSP GTPGSGTASSSPGSSTPSGATGSPGSSPSASTGTGPGSSPSASTGTGPGASPGTSSTG SPGASPGTSSTGSPGSSTPSGATGSPGSSPSASTGTGPGASPGTSSTGSPGSSPSASTG TGPGTPGSGTASSSPGSSTPSGATGSPGSSTPSGATGSPGASPGT | 166 |
| AG432A | GATGSPGSSTPSGATGSPGASPGTSSTGSPGTPGSGTASSSPGSSTPSGATGSPGSST PSGATGSPGSSTPSGATGSPGSSPSASTGTGPGASPGTSSTGSPGASPGTSSTGSPGT PGSGTASSSPGASPGTSSTGSPGASPGTSSTGSPGASPGTSSTGSPGASPGTSSTGSPG TPGSGTASSSPGSSTPSGATGSPGPTPGSGTASSSPGSSTPSGATGSPGPTPGSGTASSSP GSSTPSGATGSPGSSTPSGATGSPGSSPSASTGTGPGSSPSASTGTGPGASPGTSSTG SPGTPGSGTASSSPGSSTPSGATGSPGSSPSASTGTGPGSSPSASTGTGPGASPGTSST GSPGASPGTSSTGSPGSSTPSGATGSPGSSPSASTGTGPGASPGTSSTGSPGSSPSAST GTGPGTPGSGTASSSPGSSTPS | 167 |
| AG468A | TSSTGSPGSSPSASTGTGPGTPGSGTASSSPGASPGTSSTGSPGASPGTSSTGSPGASP GTSSTGSPGSSTPSGATGSPGSSTPSGATGSPGASPGTSSTGSPGTPGSGTASSSPGSS TPSGATGSPGSSTPSGATGSPGSSPSASTGTGPGASPGTSSTGSPG ASPGTSSTGSPGTPGSGTASSSPGASPGTSSTGSPGASPGTSSTGSPGASPGTSSTGSP GASPGTSSTGSPGTPGSGTASSSPGSSTPSGATGSPGTPGSGTASSSPGSSTPSGATG SPGTPGSGTASSSPGSSTPSGATGSPGSSTPSGATGSPGSSPSASTGTGPGSSPSASTG TGPGASPGTSSTGSPGTPGSGTASSSPGSSTPSGATGSPGSSPSASTGTGPGSSPSAST GTGPGASPGTSSTGSPGASPGTSSTGSPGSSTPSGATGSPGSSPSASTGTGPGASPG | 168 |
| AG504A | TSSTGSPGSSPSASTGTGPGTPGSGTASSSPGASPGTSSTGSPGASPGTSSTGSPGASP GTSSTGSPGSSTPSGATGSPGSSTPSGATGSPGASPGTSSTGSPGTPGSGTASSSPGSS TPSGATGSPGSSTPSGATGSPGSSTPSGATGSPGSSPSASTGTGPGASPGTSSTGSPG ASPGTSSTGSPGTPGSGTASSSPGASPGTSSTGSPGASPGTSSTGSPGASPGTSSTGSP GASPGTSSTGSPGTPGSGTASSSPGSSTPSGATGSPGTPGSGTASSSPGSSTPSGATG SPGTPGSGTASSSPGSSTPSGATGSPGSSTPSGATGSPGSSPSASTGTGPGSSPSASTG TGPGASPGTSSTGSPGTPGSGTASSSPGSSTPSGATGSPGSSPSASTGTGPGSSPSAST GTGPGASPGTSSTGSPGASPGTSSTGSPGSSTPSGATGSPGSSPSASTGTGPGASPGT SSTGSPGSSPSASTGTGPGTPGSGTASSSPGSSTP | 169 |
| AG540A | TSSTGSPGASPGTSSTGSPGSSPSASTGTGPGTPGSGTASSSPGASPGTSSTGSPGASP GTSSTGSPGASPGTSSTGSPGSSTPSGATGSPGSSTPSGATGSPGASPGTSSTGSPGTP GSGTASSSPGSSTPSGATGSPGSSTPSGATGSPGSSTPSGATGSPGSSPSASTGTGPG ASPGTSSTGSPGASPGTSSTGSPGTPGSGTASSSPGASPGTSSTGSPGASPGTSSTGSP GASPGTSSTGSPGASPGTSSTGSPGTPGSGTASSSPGSSTPSGATGSPGTPGSGTASS SPGSSTPSGATGSPGTPGSGTASSSPGSSTPSGATGSPGSSTPSGATGSPGSSPSASTG TGPGSSPSASTGTGPGASPGTSSTGSPGTPGSGTASSSPGSSTPSGATGSPGSSPSAST GTGPGSSPSASTGTGPGASPGTSSTGSPGASPGTSSTGSPGSSTPSGATGSPGSSPSAS TGTGPGASPGTSSTGSPGSSPSASTGTGPGTPGSGTASSSPGSSTPSGATGSPGSSTPS GATGSPGASPG | 170 |
| AG576A | TSSTGSPGTPGSGTASSSPGASPGTSSTGSPGASPGTSSTGSPGASPGTSSTGSPGSSP SASTGTGPGTPGSGTASSSPGASPGTSSTGSPGASPGTSSTGSPGASPGTSSTGSPGSS STPSGATGSPGSSTPSGATGSPGASPGTSSTGSPGTPGSGTASSSPGSSTPSGATGSP GSSTPSGATGSPGSSTPSGATGSPGSSPSASTGTGPGASPGTSSTGSPGASPGTSSTG SPGTPGSGTASSSPGASPGTSSTGSPGASPGTSSTGSPGASPGTSSTGSPGASPGTSST GSPGTPGSGTASSSPGSSTPSGATGSPGTPGSGTASSSPGSSTPSGATGSPGTPGSGT ASSSPGSSTPSGATGSPGSSTPSGATGSPGSSPSASTGTGPGSSPSASTGTGPGASPGT SSTGSPGTPGSGTASSSPGSSTPSGATGSPGSSPSASTGTGPGSSPSASTGTGPGASPG TSSTGSPGASPGTSSTGSPGSSTPSGATGSPGSSPSASTGTGPGASPGTSSTGSPGSSP SASTGTGPGTPGSGTASSSPGSSTPSGATGSPGSSTPSGATGSPGASPG | 171 |
| AG612A | STGSPGTPGSGTASSSPGSSTPSGATGSPGASPGTSSTGSPGTPGSGTASSSPGSSTPS GATGSPGSSPSASTGTGPGSSPSASTGTGPGSSTPSGATGSPGSSTPSGATGSPGASP GTSSTGSPGASPGTSSTGSPGASPGTSSTGSPGTPGSGTASSSPGASPGTSSTGSPGA SPGTSSTGSPGASPGTSSTGSPGSSPSASTGTGPGTASSSPGASPGTSSTGSPG ASPGTSSTGSPGASPGTSSTGSPGSSTPSGATGSPGSSTPSGATGSPGASPGTSSTGSP GTPGSGTASSSPGSSTPSGATGSPGSSTPSGATGSPGSSTPSGATGSPGSSPSASTGT GPGASPGTSSTGSPGASPGTSSTGSPGTPGSGTASSSPGASPGTSSTGSPGASPGTSS TGSPGASPGTSSTGSPGASPGTSSTGSPGTPGSGTASSSPGASPGTSSTGSPGASPGT SSTGSPGASPGTSSTGSPGTPGSGTASSSPGSSTPSGATGSPGTPGSGTASSSPGSSPS ASTGTGPGSSPSASTGTGPGASPGTSSTGSPGTPGSGTASSSPGSSTPSGATGSPGSS PSASTGTGPGSSPSASTGTGPGASPGTS | 172 |
| AG648A | GTASSSPGSSTPSGATGSPGSSPSASTGTGPGSSPSASTGTGPGSSTPSGATGSPGSST PSGATGSPGASPGTSSTGSPGASPGTSSTGSPGASPGTSSTGSPGTPGSGTASSSPGA SPGTSSTGSPGASPGTSSTGSPGASPGTSSTGSPGSSPSASTGTGPGTPGSGTASSSPG ASPGTSSTGSPGASPGTSSTGSPGASPGTSSTGSPGSSTPSGATGSPGSSTPSGATGSP GASPGTSSTGSPGTPGSGTASSSPGSSTPSGATGSPGSSTPSGATGSPGSSTPSGATG | 173 |

TABLE 2-continued

XTEN Polypeptides

| XTEN Name | Amino Acid Sequence | SEQ ID NO: |
|---|---|---|
| | SPGSSPSASTGTGPGASPGTSSTGSPGASPGTSSTGSPGTPGSGTASSSPGASPGTSST GSPGASPGTSSTGSPGASPGTSSTGSPGASPGTSSTGSPGTPGSGTASSSPGSSTPSGA TGSPGTPGSGTASSSPGSSTPSGATGSPGTPGSGTASSSPGSSTPSGATGSPGSSTPSG ATGSPGSSPSASTGTGPGSSPSASTGTGPGASPGTSSTGSPGTPGSGTASSSPGSSTPS GATGSPGSSPSASTGTGPGSSPSASTGTGPGASPGTSSTGSPGASPGTSSTGSPGSST PSGATGSPGSSPSASTGTGPGASPGTSSTGSPGSSPSASTGTGPGTPGSGTASSSPGSS TP | |
| AG684A | TSSTGSPGTPGSGTASSSPGSSTPSGATGSPGSSPSASTGTGPGSSPSASTGTGPGSST PSGATGSPGSSTPSGATGSPGASPGTSSTGSPGASPGTSSTGSPGASPGTSSTGSPGT PGSGTASSSPGASPGTSSTGSPGASPGTSSTGSPGASPGTSSTGSPGSSPSASTGTGPG TPGSGTASSSPGASPGTSSTGSPGASPGTSSTGSPGASPGTSSTGSPGSSTPSGATGSP GSSTPSGATGSPGASPGTSSTGSPGTPGSGTASSSPGSSTPSGATGSPGSSTPSGATG SPGSSTPSGATGSPGSSPSASTGTGPGASPGTSSTGSPGASPGTSSTGSPGTPGSGTA SSSPGASPGTSSTGSPGASPGTSSTGSPGASPGTSSTGSPGASPGTSSTGSPGTPGSGT ASSSPGSSTPSGATGSPGTPGSGTASSSPGSSTPSGATGSPGTPGSGTASSSPGSSTPS GATGSPGSSTPSGATGSPGSSPSASTGTGPGSSPSASTGTGPGASPGTSSTGSPGTPG SGTASSSPGSSTPSGATGSPGSSPSASTGTGPGSSPSASTGTGPGASPGTSSTGSPGAS PGTSSTGSPGSSTPSGATGSPGSSPSASTGTGPGASPGTSSTGSPGSSPSASTGTGPGT PGSGTASSSPGSSTPSGATGSPGSSTPSGATGSPGASPG | 174 |
| AG720A | TSSTGSPGTPGSGTASSSPGSSTPSGATGSPGASPGTSSTGSPGTPGSGTASSSPGSST PSGATGSPGSSPSASTGTGPGSSPSASTGTGPGSSTPSGATGSPGSSTPSGATGSPGA SPGTSSTGSPGASPGTSSTGSPGASPGTSSTGSPGTPGSGTASSSPGASPGTSSTGSPG ASPGTSSTGSPGASPGTSSTGSPGSSPSASTGTGPGTPGSGTASSSPGASPGTSSTGSP GASPGTSSTGSPGASPGTSSTGSPGSSTPSGATGSPGSSTPSGATGSPGASPGTSSTG SPGTPGSGTASSSPGSSTPSGATGSPGSSTPSGATGSPGSSTPSGATGSPGSSPSASTG TGPGASPGTSSTGSPGASPGTSSTGSPGTPGSGTASSSPGASPGTSSTGSPGASPGTS STGSPGASPGTSSTGSPGASPGTSSTGSPGTPGSGTASSSPGSSTPSGATGSPGTPGS GTASSSPGSSTPSGATGSPGTPGSGTASSSPGSSTPSGATGSPGSSTPSGATGSPGSSP SASTGTGPGSSPSASTGTGPGASPGTSSTGSPGTPGSGTASSSPGSSTPSGATGSPGS SPSASTGTGPGSSPSASTGTGPGASPGTSSTGSPGASPGTSSTGSPGSSTPSGATGSP GSSPSASTGTGPGASPGTSSTGSPGSSPSASTGTGPGTPGSGTASSSPGSSTPSGATG SPGSSTPSGATGSPGASPG | 175 |
| AG756A | TSSTGSPGSSPSASTGTGPGSSPSASTGTGPGTPGSGTASSSPGSSTPSGATGSPGSSP SASTGTGPGASPGTSSTGSPGTPGSGTASSSPGSSTPSGATGSPGTPGSGTASSSPGA SPGTSSTGSPGASPGTSSTGSPGTPGSGTASSSPGSSTPSGATGSPGASPGTSSTGSPG TPGSGTASSSPGSSTPSGATGSPGSSPSASTGTGPGSSPSASTGTGPGSSTPSGATGSP GSSTPSGATGSPGASPGTSSTGSPGASPGTSSTGSPGASPGTSSTGSPGTPGSGTASS SPGASPGTSSTGSPGASPGTSSTGSPGASPGTSSTGSPGSSPSASTGTGPGTPGSGTA SSSPGASPGTSSTGSPGASPGTSSTGSPGASPGTSSTGSPGSSTPSGATGSPGSSTPSG ATGSPGASPGTSSTGSPGTPGSGTASSSPGSSTPSGATGSPGSSTPSGATGSPGSSTPS GATGSPGSSPSASTGTGPGASPGTSSTGSPGASPGTSSTGSPGTPGSGTASSSPGASP GTSSTGSPGASPGTSSTGSPGASPGTSSTGSPGASPGTSSTGSPGTPGSGTASSSPGSS TPSGATGSPGTPGSGTASSSPGSSTPSGATGSPGTPGSGTASSSPGSSTPSGATGSPG SSTPSGATGSPGSSPSASTGTGPGSSPSASTGTGPGASPGTSSTGSPGTPGSGTASSSP GSSTPSGATGSPGSSPSASTGTGPGSSPSASTGTGPGASPGTSSTGSPGASPG | 176 |
| AG792A | TSSTGSPGSSPSASTGTGPGSSPSASTGTGPGTPGSGTASSSPGSSTPSGATGSPGSSP SASTGTGPGASPGTSSTGSPGTPGSGTASSSPGSSTPSGATGSPGTPGSGTASSSPGA SPGTSSTGSPGASPGTSSTGSPGTPGSGTASSSPGSSTPSGATGSPGASPGTSSTGSPG TPGSGTASSSPGSSTPSGATGSPGSSPSASTGTGPGSSPSASTGTGPGSSTPSGATGSP GSSTPSGATGSPGASPGTSSTGSPGASPGTSSTGSPGASPGTSSTGSPGTPGSGTASS SPGASPGTSSTGSPGASPGTSSTGSPGASPGTSSTGSPGSSPSASTGTGPGTPGSGTA SSSPGASPGTSSTGSPGASPGTSSTGSPGASPGTSSTGSPGSSTPSGATGSPGSSTPSG ATGSPGASPGTSSTGSPGTPGSGTASSSPGSSTPSGATGSPGSSTPSGATGSPGSSTPS GATGSPGSSPSASTGTGPGASPGTSSTGSPGASPGTSSTGSPGASPGTSSTGSPGASP GTSSTGSPGASPGTSSTGSPGASPGTSSTGSPGTPGSGTASSSPGSS TPSGATGSPGTPGSGTASSSPGSSTPSGATGSPGTPGSGTASSSPGSSTPSGATGSPG SSTPSGATGSPGSSPSASTGTGPGSSPSASTGTGPGASPGTSSTGSPGTPGSGTASSSP GSSTPSGATGSPGSSPSASTGTGPGSSPSASTGTGPGASPGTSSTGSPGASPGTSSTG SPGSSTPSGATGSPGSSPSASTGTGPGASPG | 177 |
| AG828A | TSSTGSPGSSPSASTGTGPGSSPSASTGTGPGTPGSGTASSSPGSSTPSGATGSPGSSP SASTGTGPGASPGTSSTGSPGTPGSGTASSSPGSSTPSGATGSPGTPGSGTASSSPGA SPGTSSTGSPGASPGTSSTGSPGTPGSGTASSSPGSSTPSGATGSPGASPGTSSTGSPG TPGSGTASSSPGSSTPSGATGSPGSSPSASTGTGPGSSPSASTGTGPGSSTPSGATGSP GSSTPSGATGSPGASPGTSSTGSPGASPGTSSTGSPGASPGTSSTGSPGTPGSGTASS SPGASPGTSSTGSPGASPGTSSTGSPGASPGTSSTGSPGSSPSASTGTGPGTPGSGTA SSSPGASPGTSSTGSPGASPGTSSTGSPGASPGTSSTGSPGSSTPSGATGSPGSSTPSG ATGSPGASPGTSSTGSPGTPGSGTASSSPGSSTPSGATGSPGSSTPSGATGSPGSSTPS GATGSPGSSPSASTGTGPGASPGTSSTGSPGASPGTSSTGSPGASPGTSSTGSPGASP GTSSTGSPGASPGTSSTGSPGASPGTSSTGSPGTPGSGTASSSPGSS TPSGATGSPGTPGSGTASSSPGSSTPSGATGSPGTPGSGTASSSPGSSTPSGATGSPG | 178 |

TABLE 2-continued

XTEN Polypeptides

| XTEN Name | Amino Acid Sequence | SEQ ID NO: |
|---|---|---|
| | SSTPSGATGSPGSSPSASTGTGPGSSPSASTGTGPGASPGTSSTGSPGTPGSGTASSSP GSSTPSGATGSPGSSPSASTGTGPGSSPSASTGTGPGASPGTSSTGSPGASPGTSSTG SPGSSTPSGATGSPGSSPSASTGTGPGASPGTSSTGSPGSSPSASTGTGPGTPGSGTA SSSPGSSTP | |
| AE869 | GSPGSPAGSPTSTEEGTSESATPESGPGTSTEPSEGSAPGSPAGSPTSTEEGTSTEPSE GSAPGTSTEPSEGSAPGTSESATPESGPGSEPATSGSETPGSEPATSGSETPGSPAGSP TSTEEGTSESATPESGPGTSTEPSEGSAPGTSTEPSEGSAPGSPAGSPTSTEEGTSTEP SEGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSPA GSPTSTEEGTSESATPESGPGSEPATSGSETPGTSESATPESGPGTSTEPSEGSAPGTS TEPSEGSAPGTSTEPSEGSAPGTSTEPSEGSAPGTSTEPSEGSAPGTSTEPSEGSAPGS PAGSPTSTEEGTSTEPSEGSAPGTSESATPESGPGSEPATSGSETPGTSESATPESGPG SEPATSGSETPGTSESATPESGPGTSTEPSEGSAPGTSESATPESGPGSPAGSPTSTEE GSPAGSPTSTEEGSPAGSPTSTEEGTSESATPESGPGTSTEPSEGSAPGTSESATPESG PGSEPATSGSETPGTSESATPESGPGSEPATSGSETPGTSESATPESGPGTSTEPSEGS APGSPAGSPTSTEEGTSESATPESGPGSEPATSGSETPGTSESATPESGPGSPAGSPTS TEEGSPAGSPTSTEEGTSTEPSEGSAPGTSESATPESGPGTSESATP ESGPGSEPATSGSETPGSEPATSGSETPGSPAGSPTSTEEGTSTEPSEGSAPGTSTEPS EGSAPGSEPATSGSETPGTSESATPESGPGTSTEPSEGSAPGR | 179 |
| AE144_R1 | SAGSPGSPAGSPTSTEEGTSESATPESGPGTSTEPSEGSAPGSPAGSPTSTEEGTSTEP SEGSAPGTSTEPSEGSAPGTSESATPESGPGSEPATSGSETPGSEPATSGSETPGSPAG SPTSTEEGTSESATPESGPGTESASR | 180 |
| AE288_R1 | SAGSPTGPGSEPATSGSETPGTSESATPESGPGSEPATSGSETPGTSESATPESGPGTS TEPSEGSAPGSPAGSPTSTEEGTSESATPESGPGSEPATSGSETPGTSESATPESGPGS PAGSPTSTEEGSPAGSPTSTEEGTSTEPSEGSAPGTSESATPESGPGTSESATPESGPG TSESATPESGPGSEPATSGSETPGSEPATSGSETPGSPAGSPTSTEEGTSTEPSEGSAP GTSTEPSEGSAPGSEPATSGSETPGTSESATPESGPGTSTEPSEGSAPSASR | 181 |
| AE432_R1 | SAGSPGSPAGSPTSTEEGTSESATPESGPGTSTEPSEGSAPGSPAGSPTSTEEGTSTEP SEGSAPGTSTEPSEGSAPGTSESATPESGPGSEPATSGSETPGSEPATSGSETPGSPAG SPTSTEEGTSESATPESGPGTSTEPSEGSAPGTSTEPSEGSAPGSPAGSPTSTEEGTST EPSEGSAPGTSTEPSEGSAPGTSESATPESGPGTSTEPSEGSAPGTSESATPESGPGSE PATSGSETPGTSTEPSEGSAPGTSTEPSEGSAPGTSESATPESGPGTSESATPESGPGS PAGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAP GSPAGSPTSTEEGTESASR | 182 |
| AE576_R1 | SAGSPTEEGTSESATPESGPGSEPATSGSETPGTSESATPESGPGTSTEPSEGSAPGTS TEPSEGSAPGTSTEPSEGSAPGTSTEPSEGSAPGTSTEPSEGSAPGTSTEPSEGSAPGS PAGSPTSTEEGTSTEPSEGSAPGTSESATPESGPGSEPATSGSETPGTSESATPESGPG SEPATSGSETPGTSESATPESGPGTSTEPSEGSAPGTSESATPESGPGSPAGSPTSTEE GSPAGSPTSTEEGTSESATPESGPGTSTEPSEGSAPGTSESATPESG PGSEPATSGSETPGTSESATPESGPGSEPATSGSETPGTSESATPESGPGTSTEPSEGS APGSPAGSPTSTEEGTSESATPESGPGSEPATSGSETPGTSESATPESGPGSPAGSPTS TEEGSPAGSPTSTEEGTSTEPSEGSAPGTSESATPESGPGTSESATP ESGPGSEPATSGSETPGSEPATSGSETPGSPAGSPTSTEEGTSTEPSEGSAPGTSTEPS EGSAPGSEPATSGSETPGTSESATPESGPGTSTEPSEGSAPSASR | 183 |
| AE864_R1 | SAGSPGSPAGSPTSTEEGTSESATPESGPGTSTEPSEGSAPGSPAGSPTSTEEGTSTEP SEGSAPGTSTEPSEGSAPGTSESATPESGPGSEPATSGSETPGSEPATSGSETPGSPAG SPTSTEEGTSESATPESGPGTSTEPSEGSAPGTSTEPSEGSAPGSPAGSPTSTEEGTST EPSEGSAPGTSTEPSEGSAPGTSESATPESGPGTSTEPSEGSAPGTSESATPESGPGSE PATSGSETPGTSTEPSEGSAPGTSTEPSEGSAPGTSESATPESGPGTSESATPESGPGS PAGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPESG PGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGTSESATPE SGPGSEPATSGSETPGTSESATPESGPGSEPATSGSETPGTSESATPESGPGTSTEPSE GSAPGSPAGSPTSTEEGTSESATPESGPGSEPATSGSETPGTSESATPESGPGSPAGSP TSTEEGSPAGSPTSTEEGTSTEPSEGSAPGTSESATPESGPGTSESATPESGPGTSESA TPESGPGSEPATSGSETPGSEPATSGSETPGSPAGSPTSTEEGTSTEPSEGSAPGTSTE PSEGSAPGSEPATSGSETPGTSESATPESGPGTESASR | 184 |
| AF864_R1 | SAGSPGSTSSTAESPGPGSTSSTAESPGPGSTSESPSGTAPGSTSSTAESPGPGSTSST AESPGPGTSTPESGSASPGSTSESPSGTAPGSTSPSGESSTAPGSTSESPSGTAPGSTS ESPSGTAPGSTSPSGESSTAPGSTSESPSGTAPGSTSESPSGTAPGSTSPSGESSTAPGSTS ESPSGTAPGSTSESPSGTAPGSTSESPSGTAPGSTSPSGESSASPGSTSESPSGTAPGSTS TPESGSASPGSTSSTAESPGPGSTSSTAESPGPGTSTPESGSASPGSTSTPESGSASPGS TSESPSGTAPGSTSTPESGSASPGSTSESPSGTAPGSTSESPSGTAPG STSESPSGTAPGSTSSTAESPGPGTSTPESGSASPGSTSTPESGSASPGSTSESPSGTAP GSTSESPSGTAPGSTSTPESGSASPGSTSESPSGTAPGSTSESPSGTAPGSTSTPESGSAS | 185 |

TABLE 2-continued

XTEN Polypeptides

| XTEN Name | Amino Acid Sequence | SEQ ID NO: |
|---|---|---|
| | PGTSPSGESSTAPGSTSSTAESPGPGTSPSGESSTAPGSTSSTAESPGPGTSTPESGSA SPGSTSESPSGTAPGSTSSTAESPGPGTSTPESGSASPGTSTPESGSASPGSTSSTAES PGPGTSPSGESSTAPGTSTPESGSASPGSTSESPSGTAPGSTSESPSGTAPGTSTPESG SASPGTSPSGESSTAPGSTSSTAESPGPGTSPSGESSTAPGSTSSTAESPGPGSTSSTA ESPGPGTSPSGESSTAPGSTSESPSGTAPGSTSESPSGTAPGTSTPESGSASPGSTSES PSGTAPGSTSESPSGTAPGTSTPESGSASPGSTSESPSGTAPGSTSESPSGTAPGSTSE SPSGTAPGSTSSTAESPGPGTSPSGESSTAPGTSSASR | |
| AG864_R1 | SAGSPGASPGTSSTGSPGSSPSASTGTGPGSSPSASTGTGPGTPGSGTASSSPGSSTPS GATGSPGSSPSASTGTGPGASPGTSSTGSPGTPGSGTASSSPGSSTPSGATGSPGTPGS GTASSSPGASPGTSSTGSPGASPGTSSTGSPGTPGSGTASSSPGSSTPSGATGSPGASP GTSSTGSPGTPGSGTASSSPGSSTPSGATGSPGSSPSASTGTGPGSSPSASTGTGPGSS TPSGATGSPGSSTPSGATGSPGASPGTSSTGSPGASPGTSSTGSPGASPGTSSTGSPGT PGSGTASSSPGASPGTSSTGSPGASPGTSSTGSPGASPGTSSTGSPGSSPSASTGTGPG TPGSGTASSSPGASPGTSSTGSPGASPGTSSTGSPGASPGTSSTGSPGSSTPSGATGSP GSSTPSGATGSPGASPGTSSTGSPGTPGSGTASSSPGSSTPSGATGSPGSSTPSGATGS PGSSTPSGATGSPGSSPSASTGTGPGASPGTSSTGSPGASPGTSSTGSPGTPGSGTASS SPGASPGTSSTGSPGASPGTSSTGSPGASPGTSSTGSPGASPGTSSTGSPGTPGSGTAS SSPGSSTPSGATGSPGTPGSGTASSSPGSSTPSGATGSPGTPGSGTASSSPGSSTPSGA TGSPGSSTPSGATGSPGSSPSASTGTGPGSSPSASTGTGPGASPGTSSTGSPGTPGSGT ASSSPGSSTPSGATGSPGSSPSASTGTGPGSSPSASTGTGPGASPGTSSTGSPGASPGT SSTGSPGSSTPSGATGSPGSSPSASTGTGPGASPGTSSTGSPGSSPSASTGTGPGTPGS GTASSSPGSSTPSGATGSPGSSTPSGATGSPGASSASR | 186 |

In some embodiments wherein the XTEN has less than 100% of its amino acids consisting of 4, 5, or 6 types of amino acid selected from glycine (G), alanine (A), serine (S), threonine (T), glutamate (E) and proline (P), or less than 100% of the sequence consisting of the sequence motifs from Table 1 or the XTEN sequences of Tables 2, 3 and 22-25 the other amino acid residues of the XTEN are selected from any of the other 14 natural L-amino acids, but are preferentially selected from hydrophilic amino acids such that the XTEN sequence contains at least about 90%, 91%, 92%, 93%, 94%, 95%, 96%, 97%, 98%, or at least about 99% hydrophilic amino acids. An individual amino acid or a short sequence of amino acids other than glycine (G), alanine (A), serine (S), threonine (T), glutamate (E) and proline (P) may be incorporated into the XTEN to achieve a needed property, such as to permit incorporation of a restriction site by the encoding nucleotides, or to facilitate linking to a payload component, or incorporation of a cleavage sequence. As one exemplary embodiment, described more fully below, the invention provides XTEN that incorporates from 1 to about 20, or 1 to about 15, or 1 to about 10, or 1 to 5 lysine residues wherein the reactive lysines are utilized for linking to cross-linkers or payloads, as described herein. In another embodiment, described more fully below, the XTEN incorporates from 1 to about 20, or 1 to about 15, or 1 to about 10, or 1 to 5 cysteine residues wherein the reactive cysteines are utilized for linking to cross-linkers or payloads, as described herein. In another embodiment, the XTEN incorporates from 1 to about 20 cysteine and lysine residues wherein the lysines and cysteines are utilized for linking to different cross-linkers or payloads, as described herein. In another embodiment, the XTEN incorporations 1, 2, 3, 4, 5 or more arginine residues that are not followed by proline residues to provide cleavage sequences that can be cleaved by trypsin to create XTEN segments, described more fully herein, below. The XTEN amino acids that are not glycine (G), alanine (A), serine (S), threonine (T), glutamate (E) and proline (P) are either interspersed throughout the XTEN sequence, are located within or between the sequence motifs, or are concentrated in one or more short stretches of the XTEN sequence such as at or near the N- or C-terminus. As hydrophobic amino acids impart structure to a polypeptide, the invention provides that the content of hydrophobic amino acids in the XTEN utilized in the conjugation constructs will typically be less than 5%, or less than 2%, or less than 1% hydrophobic amino acid content. Hydrophobic residues that are less favored in construction of XTEN include tryptophan, phenylalanine, tyrosine, leucine, isoleucine, valine, and methionine. Additionally, one can design the XTEN sequences to contain less than 5% or less than 4% or less than 3% or less than 2% or less than 1% or none of the following amino acids: methionine (to avoid oxidation), asparagine and glutamine (to avoid desamidation). In other embodiments, the amino acid content of methionine and tryptophan in the XTEN component used in the conjugation constructs is typically less than 5%, or less than 2%, and most preferably less than 1%. In other embodiments, the XTEN of the subject XTEN conjugates will have a sequence that has less than 10% amino acid residues with a positive charge, or less than about 7%, or less that about 5%, or less than about 2% amino acid residues with a positive charge, the sum of methionine and tryptophan residues will be less than 2%, and the sum of asparagine and glutamine residues will be less than 5% of the total XTEN sequence.

3. Cysteine- and Lysine-Engineered XTEN Sequences

In another aspect, the invention provides XTEN with defined numbers of incorporated cysteine or lysine residues; "cysteine-engineered XTEN" and "lysine-engineered XTEN", respectively. It is an object of the invention to provide XTEN with defined numbers of cysteine and/or lysine residues to permit conjugation between the thiol group of the cysteine or the epsilon amino group of the lysine and a reactive group on a payload or a cross-linker to be conjugated to the XTEN backbone. In one embodiment of the foregoing, the XTEN of the invention has between about 1 to about 100 lysine residues, or about 1 to about 70 lysine residues, or about 1 to about 50 lysine residues, or about 1 to about 30 lysine residues, or about 1 to about 20 lysine residues, or about 1 to about 10 lysine residues, or about 1 to about 5 lysine residues, or 1 to about 3 lysine residues, or alternatively only a single lysine residue. In another embodiment of the foregoing, the XTEN of the invention has between about 1 to about 100 cysteine residues, or about 1 to about 70 cysteine residues, or about 1 to about 50 cysteine residues, or about 1 to about 30 cysteine residues, or about 1 to about 20 cysteine residues, or about 1 to about 10 cysteine residues, or about 1 to about 5 cysteine residues, or 1 to about 3 cysteine residues, or alternatively only a single cysteine residue. In another embodiment of the foregoing, the XTEN of the invention has about 1 to about 10 lysine residues and about 1 to about 10 cysteine residues. Using the foregoing lysine- and/or cysteine-containing XTEN, conjugates can be constructed that comprise XTEN, an optional cross-linker, plus a payload useful in the treatment of a condition in a subject wherein the maximum number of molecules of the payload agent linked to the XTEN component is determined by the numbers of lysines, cysteines or other amino acids with a reactive side group (e.g., a terminal amino or thiol) incorporated into the XTEN.

Figure 40:
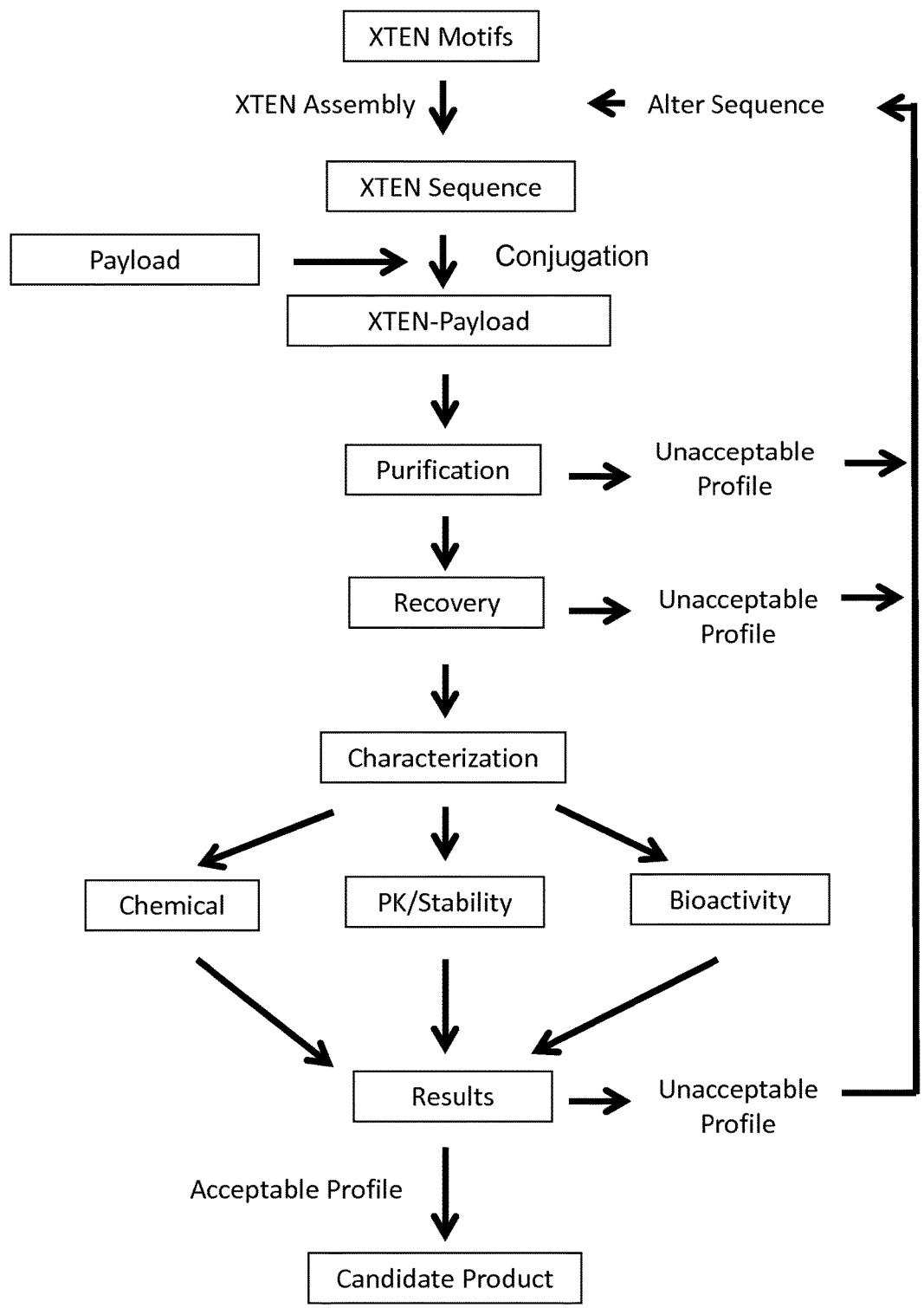
FIG. 40 is a schematic flowchart of representative steps in the assembly of a gene encoding XTEN, its expression, conjugation with a payload and recovery as an XTEN-paylad, and its evaluation as a candidate product.

In one embodiment, the invention provides cysteine-engineered XTEN where nucleotides encoding one or more amino acids of an XTEN are replaced with a cysteine amino acid to create the cysteine-engineered XTEN gene. In another embodiment, the invention provides cysteine-engineered XTEN where nucleotides encoding one or more cysteine amino acids are inserted into an-XTEN encoding gene to create the cysteine-engineered XTEN gene. In other cases, oligonucleotides encoding one or more motifs of about 9 to about 14 amino acids comprising codons encoding one or more cysteines are linked in frame with other oligos encoding XTEN motifs or full-length XTEN to create the cysteine-engineered XTEN gene. In one embodiment of the foregoing, where the one or more cysteines are inserted into an XTEN sequence during the creation of the XTEN gene, nucleotides encoding cysteine can be linked to codons encoding amino acids used in XTEN to create a cysteine-XTEN motif with the cysteine(s) at a defined position using the methods described herein (see Example 61 and FIGS. 40-41), or by standard molecular biology techniques, and the motifs subsequently assembled into the gene encoding the full-length cysteine-engineered XTEN. In such cases, where, for example, nucleotides encoding a single cysteine are added to the DNA encoding a motif selected from Table 1, the resulting motif would have 13 amino acids, while incorporating two cysteines would result in a motif having 14 amino acids, etc. In other cases, a cysteine-motif can be created de novo and be of a pre-defined length and number of cysteine amino acids by linking nucleotides encoding cysteine to nucleotides encoding one or more amino acid residues used in XTEN (e.g., G, S, T, E, P, A) at a defined position, and the encoding motifs subsequently assembled by annealing with other XTEN-encoding motif sequences into the gene encoding the full-length XTEN, as described herein and illustrated in FIGS. 7-8. In cases where a lysine-engineered XTEN is utilized to make the conjugates of the invention, the approaches described above would be performed with codons encoding lysine instead of cysteine. Thus, by the foregoing, a new XTEN motif can be created that could comprise about 9-14 amino acid residues and have one or more reactive amino acids; i.e., cysteine or lysine. Non-limiting examples of motifs suitable for use in an engineered XTEN that contain a single cysteine or lysine are:

| | |
|---|---|
| GGSPAGSCTSP | (SEQ ID NO: 187) |
| GASASCAPSTG | (SEQ ID NO: 188) |
| TAEAAGCGTAEAA | (SEQ ID NO: 189) |
| GPEPTCPAPSG | (SEQ ID NO: 190) |
| GGSPAGSKTSP | (SEQ ID NO: 191) |
| GASASKAPSTG | (SEQ ID NO: 192) |

However, the invention contemplates motifs of different lengths, such as those of Table 5 and Table 11, for incorporation into XTEN.

In such cases where a gene encoding an XTEN with one or more cysteine and/or lysine motifs is to be constructed from existing XTEN motifs or segments, the gene can be designed and built by linking existing "building block" polynucleotides encoding both short- and long-length XTENs; e.g., AE48, AE144, AE288, AE432, AE576, AE864, AM48, AM875, AE912, AG864, or the nucleotides encoding the 36'mers of Examples 1-4, and Tables 22-25, which can be fused in frame with the nucleotides encoding the cysteine- and/or lysine-containing motifs or, alternatively, the cysteine- and/or lysine-encoding nucleotides can be PCR'ed into an existing XTEN sequence (as described more fully below and in the Examples) using, for example, nucleotides encoding the islands of Tables 4 and 5 to build an engineered XTEN in which the reactive cysteine and/or lysines are placed in one or more designed locations in the sequence in the desired quantity. Non-limiting examples of such engineered XTEN are provided in Table 3. Thus, in one embodiment, the invention provides an XTEN sequence having at least about 80% sequence identity, or at least about 90%, or about 91%, or about 92%, or about 93%, or about 94%, or about 95%, or about 96%, or about 97%, or about 98%, or about 99% sequence identity, or is identical to a sequence or a fragment of a sequence selected from of Table 3, when optimally aligned. However, application of the cysteine- or lysine-engineered methodology to create XTEN encompassing cysteine or lysine residues is not meant to be constrained to the precise compositions or range of composition identities of the foregoing embodiments. As will be appreciated by those skilled in the art, the precise location and numbers of incorporated cysteine or lysine residues in an XTEN can be varied without departing from the invention as described.

TABLE 3

Cysteine- and lysine-engineered XTEN

| Name | Amino Acid Sequence | SEQ ID NO: |
|---|---|---|
| Seg 1 | AGSPAGSPTSTEEGTSESATPESGPGTSTEPSEGSAPGSPAGSPTSTEEGTSTEPSEGSAP<br>GTSTEPSEGSAPGTSESATPESGPGSEPATSGSETPGSEPATSGSETPGSPAGSPTSTEEG<br>TSESATPESGPGTSTEPSEGSAPGTSTEPSEGSAPGSPAGSPTSTEEGTSTEPSEGSAPGT<br>STEPSEGSAPGTSESATPESGPGTSTEPSEGSAPGTSESATPESGPGSEPATSGSETPGTS | 193 |

TABLE 3-continued

Cysteine- and lysine-engineered XTEN

| Name | Amino Acid Sequence | SEQ ID NO: |
|---|---|---|
| | TEPSEGSAPGTSTEPSEGSAPGTSESATPESGPGTSESATPESGPGSPAGSPTSTEEGTSE<br>SATPESGPGSEPATSGSETPGTSESATPESGPGTSTEPSEGSAPGTSTEPSEGSAPGTSTE<br>PSEGSAPGTSTEPSEGSAPGTSTEPSEGSAPGTSTEPSEGSAPGSPAGSPTSTEEGTSTEPS<br>EGSAPTAEAAGCGTAEAAGTSESATPESGPGSEPATSGSETPGTSESATPESGPGSEPAT<br>SGSETPGTSESATPESGPGTSTEPSEGSAPGTSESATPESGPGSPAGSPTSTEEGSPAGSP<br>TSTEEGSPAGSPTSTEEGTSESATPESGPGTSTEPSEGSAPGTSESATPESGPGSEPATSG<br>SETPGTSESATPESGPGSEPATSGSETPGTSESATPESGPGTSTEPSEGSAPGSPAGSPTST<br>EEGTSESATPESGPGSEPATSGSETPGTSESATPESGPGSPAGSPTSTEEGSPAGSPTSTE<br>EGTSTEPSEGSAPGTSESATPESGPGTSESATPESGPGTSESATPESGPGSEPATSGSETP<br>GSEPATSGSETPGSPAGSPTSTEEGTSTEPSEGSAPGTSTEPSEGSAPGSEPATSGSETPG<br>TSESATPESGPGTSTEPSEGSAPR | |
| Seg 2 | ATAEAAGCGTAEAAGSPAGSPTSTEEGTSESATPESGPGTSTEPSEGSAPGSPAGSPTST<br>EEGTSTEPSEGSAPGTSTEPSEGSAPGTSESATPESGPGSEPATSGSETPGSEPATSGSET<br>PGSPAGSPTSTEEGTSESATPESGPGTSTEPSEGSAPGTSTEPSEGSAPGSPAGSPTSTEE<br>GTSTEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPGTSESATPESGPGSEPATSGSETPGTSESATPESGPGSEPATS<br>GSETPGTSESATPESGPGTSTEPSEGSAPGTSESATPESGPGSPAGSPTSTEEGSPAGSPT<br>STEEGSPAGSPTSTEEGTSESATPESGPGTSTEPSEGSAPGTSESATPESGPGSEPATSGS<br>ETPGTSESATPESGPGSEPATSGSETPGTSESATPESGPGTSTEPSEGSAPGSPAGSPTST<br>EEGTSESATPESGPGSEPATSGSETPGTSESATPESGPGSPAGSPTSTEEGSPAGSPTSTE<br>EGTSTEPSEGSAPGTSESATPESGPGTSESATPESGPGTSESATPESGPGSEPATSGSETP<br>GSEPATSGSETPGSPAGSPTSTEEGTSTEPSEGSAPGTSTEPSEGSAPGSEPATSGSETPG<br>TSESATPESGPGTSTEPSEGSAPTAEAAGCGTAEAAR | 194 |
| Seg 3 | ATAEAAGCGTAEAAGSPAGSPTSTEEGTSESATPESGPGTSTEPSEGSAPGSPAGSPTST<br>EEGTSTEPSEGSAPGTSTEPSEGSAPGTSESATPESGPGSEPATSGSETPGSEPATSGSET<br>PGSPAGSPTSTEEGTSESATPESGPGTSTEPSEGSAPGTSTEPSEGSAPGSPAGSPTSTEE<br>GTSTEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPTAEAAGCGTAEAAGTSESATPESGPGSEPATSGSETPGTSE<br>SATPESGPGSEPATSGSETPGTSESATPESGPGTSTEPSEGSAPGTSESATPESGPGSPAG<br>SPTSTEEGSPAGSPTSTEEGSPAGSPTSTEEGTSESATPESGPGTSTEPSEGSAPGTSESAT<br>PESGPGSEPATSGSETPGTSESATPESGPGSEPATSGSETPGTSESATPESGPGTSTEPSE<br>GSAPGSPAGSPTSTEEGTSESATPESGPGSEPATSGSETPGTSESATPESGPGSPAGSPTS<br>TEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSA<br>PGSEPATSGSETPGTSESATPESGPGTSTEPSEGSAPTAEAAGCGTAEAAR | 195 |
| Seg 4 | ATAEAAGCGTAEAAGSPAGSPTSTEEGTSESATPESGPGTSTEPSEGSAPGSPAGSPTST<br>EEGTSTEPSEGSAPGTSTEPSEGSAPGTSESATPESGPGSEPATSGSETPGSEPATSGSET<br>PGSPAGSPTSTEEGTSESATPESGPGTSESATPESGPGSEPATSGSETPGSPAGSPTSTEE<br>GTSTEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGTSESATPESGPTA<br>EAAGCGTAEAAGSPAGSPTSTEEGTSESATPESGPGSEPATSGSETPGTSESATPESGPG<br>TSTEPSEGSAPGTSTEPSEGSAPGTSTEPSEGSAPGTSTEPSEGSAPGTSTEPSEGSAPGT<br>STEPSEGSAPGSPAGSPTSTEEGTSTEPSEGSAPGTSESATPESGPGSEPATSGSETPGTS<br>ESATPESGPGSEPATSGSETPGTSESATPESGPGTSTEPSEGSAPGTSESATPESGPGSPA<br>GSPTSTEEGSPAGSPTSTEEGSPAGSPTSTEEGTSESATPESGPGTSTEPSEGSAPTAEAA<br>GCGTAEAAGTSESATPESGPGSEPATSGSETPGTSESATPESGPGSEPATSGSETPGTSE<br>SATPESGPGTSTEPSEGSAPGSPAGSPTSTEEGTSESATPESGPGSEPATSGSETPGTSES<br>ATPESGPGSPAGSPTSTEEGSPAGSPTSTEEGTSTEPSEGSAPGTSESATPESGPGTSESA<br>TPESGPGTSESATPESGPGSEPATSGSETPGSEPATSGSETPGSPAGSPTSTEEGTSTEPSE<br>GSAPGTSTEPSEGSAPGSEPATSGSETPGTSESATPESGPGTSTEPSEGSAPTAEAAGCG<br>TAEAAR | 196 |
| Seg 5 | ATAEAAGCGTAEAAGSPAGSPTSTEEGTSESATPESGPGTSTEPSEGSAPGSPAGSPTST<br>EEGTSTEPSEGSAPGTSTEPSEGSAPGTSESATPESGPGSEPATSGSETPGSEPATSGSET<br>PGSPAGSPTSTEEGTSESATPESGPGTSTEPSEGSAPGTSTEPSEGSAPGSPAGSPTSTEE<br>GTSTEPSEGSAPGTSTEPSEGSAPGTSESATPESGPGTSTEPSEGSAPTAEAAGCGTAEA<br>AGTSESATPESGPGSEPATSGSETPGTSTEPSEGSAPGTSTEPSEGSAPGTSESATPESGP<br>GTSESATPESGPGSPAGSPTSTEEGTSESATPESGPGSEPATSGSETPGTSESATPESGPG<br>TSTEPSEGSAPGTSTEPSEGSAPGTSTEPSEGSAPGTSTEPSEGSAPGTSTEPSEGSAPGT<br>STEPSEGSAPGSPAGSPTSTEEGTSTEPSEGSAPTAEAAGCGTAEAAGTSESATPESGPG<br>SEPATSGSETPGTSESATPESGPGSEPATSGSETPGTSESATPESGPGTSTEPSEGSAPGT<br>SESATPESGPGSPAGSPTSTEEGSPAGSPTSTEEGSPAGSPTSTEEGTSESATPESGPGTS<br>TEPSEGSAPGTSESATPESGPGSEPATSGSETPGTSESATPESGPGSEPATSGSETPGTSE<br>SATPESGPGTSTEPSEGSAPTAEAAGCGTAEAAGSPAGSPTSTEEGTSESATPESGPGSE<br>PATSGSETPGTSESATPESGPGSPAGSPTSTEEGSPAGSPTSTEEGTSTEPSEGSAPGTSE | 197 |

TABLE 3-continued

Cysteine- and lysine-engineered XTEN

| Name | Amino Acid Sequence | SEQ ID NO: |
|---|---|---|
| | SATPESGPGTSESATPESGPGTSESATPESGPGSEPATSGSETPGSEPATSGSETPGSPAG SPTSTEEGTSTEPSEGSAPGTSTEPSEGSAPGSEPATSGSETPGTSESATPESGPGTSTEPS EGSAPTAEAAGCGTAEAAR | |
| Seg 6 | ATAEAAGCGTAEAAGSPAGSPTSTEEGTSESATPESGPGTSTEPSEGSAPGSPAGSPTST EEGTSTEPSEGSAPGTSTEPSEGSAPGTSESATPESGPGSEPATSGSETPGSEPATSGSET PGSPAGSPTSTEEGTSESATPESGPGTSTEPSEGSAPGTSTEPSEGSAPGSPAGSPTSTEE GTSTETAEAAGCGTAEAAPSEGSAPGTSTEPSEGSAPGTSESATPESGPGTSTEPSEGSA PGTSESATPESGPGSPAGSPTSTEEGTSESATPESGPGTSTEPSEGSAPGTSESATPESGP GTSESATPESGPSPAGSPTSTEEGTSESATPESGPGSEPATSGSETPGTSESATPESGPG TSTEPSEGSTAEAAGCGTAEAAAPGTSTEPSEGSAPGTSTEPSEGSAPGTSTEPSEGSAP GTSTEPSEGSAPGTSTEPSEGSAPGSPAGSPTSTEEGTSTEPSEGSAPGTSESATPESGPG SEPATSGSETPGTSESATPESGPGSEPATSGSETPGTSESATPESGPGTSTEPSEGSAPGT SESATPESGPGSTAEAAGCGTAEAAPAGSPTSTEEGSPAGSPTSTEEGSPAGSPTSTEEG TSESATPESGPGTSTEPSEGSAPGTSESATPESGPGSEPATSGSETPGTSESATPESGPGS EPATSGSETPGTSESATPESGPGTSTEPSEGSAPGSPAGSPTSTEEGTSESATPESGPGSE PATSGSETPGTSESATTAEAAGCGTAEAAPESGPGSPAGSPTSTEEGSPAGSPTSTEEGT STEPSEGSAPGTSESATPESGPGTSESATPESGPGTSESATPESGPGSEPATSGSETPGSEP ATSGSETPGSPAGSPTSTEEGTSTEPSEGSAPGTSTEPSEGSAPGSEPATSGSETPGTSES ATPESGPGTSTEPSEGSAPTAEAAGCGTAEAAR | 198 |
| Seg 7 | ATAEAAGCGTAEAAGSPAGSPTSTEEGTSESATPESGPGTSTEPSEGSAPGSPAGSPTST EEGTSTEPSEGSAPGTSTEPSEGSAPGTSESATPESGPGSEPATSGSETPGSEPATSGSET PGSPAGSPTSTEEGTSESATPESGPGTSTEPSEGSAPTAEAAGCGTAEAAGTSTEPSEGS APGSPAGSPTSTEEGTSTEPSEGSAPGTSTEPSEGSAPGTSESATPESGPGTSTEPSEGSA PGTSESATPESGPGSEPATSGSETPGTSTEPSEGSAPGTSTEPSEGSAPGTSESATPESGP GTSESATPESGPTAEAAGCGTAEAAGSPAGSPTSTEEGTSESATPESGPGSEPATSGSET PGTSESATPESGPGTSTEPSEGSAPGTSTEPSEGSAPGTSTEPSEGSAPGTSTEPSEGSAP GTSTEPSEGSAPGTSTEPSEGSAPGSPAGSPTSTEEGTSTEPSEGSAPTAEAAGCGTAEA AGTSESATPESGPGSEPATSGSETPGTSESATPESGPGSEPATSGSETPGTSESATPESGP GTSTEPSEGSAPGTSESATPESGPGSPAGSPTSTEEGSPAGSPTSTEEGSPAGSPTSTEEG TSESATPESGPGTSTEPSEGSAPTAEAAGCGTAEAAGTSESATPESGPGSEPATSGSETP GTSESATPESGPGSEPATSGSETPGTSESATPESGPGTSTEPSEGSAPGSPAGSPTSTEEG TSESATPESGPGSEPATSGSETPGTSESATPESGPGSPAGSPTSTEEGSPAGSPTSTEETA EAAGCGTAEAAGTSTEPSEGSAPGTSESATPESGPGTSESATPESGPGTSESATPESGPG SEPATSGSETPGSEPATSGSETPGSPAGSPTSTEEGTSTEPSEGSAPGTSTEPSEGSAPGS EPATSGSETPGTSESATPESGPGTSTEPSEGSAPTAEAAGCGTAEAAR | 199 |
| Seg 8 | ATAEAAGCGTAEAAGSPAGSPTSTEEGTSESATPESGPGTSTEPSEGSAPGSPAGSPTST EEGTSTEPSEGSAPGTSTEPSEGSAPGTSESATPESGPGSEPATSGSETPGSEPATSGSET PGSPAGSPTSTEEGTSTAEAAGCGTAEAAESATPESGPGTSTEPSEGSAPGTSTEPSEGS APGSPAGSPTSTEEGTSTEPSEGSAPGTSTEPSEGSAPGTSESATPESGPGTSTEPSEGSA PGTSESATPESGPGSEPATSGSETPGTSTEPSTAEAAGCGTAEAAEGSAPGTSTEPSEGS APGTSESATPESGPGTSESATPESGPGSPAGSPTSTEEGTSESATPESGPGSEPATSGSET PGTSESATPESGPGTSTEPSEGSAPGTSTEPSEGSAPGTSTEPSEGSTAEAAGCGTAEAA APGTSTEPSEGSAPGTSTEPSEGSAPGTSTEPSEGSAPGSPAGSPTSTEEGTSTEPSEGSA PGTSESATPESGPGSEPATSGSETPGTSESATPESGPGSEPATSGSETPGTSESATPESGP GTTAEAAGCGTAEAASTEPSEGSAPGTSESATPESGPGSPAGSPTSTEEGSPAGSPTSTE EGSPAGSPTSTEEGTSESATPESGPGTSTEPSEGSAPGTSESATPESGPGSEPATSGSETP GTSESATPESGPGSEPATAEAAGCGTAEAATSGSETPGTSESATPESGPGTSTEPSEGSA PGSPAGSPTSTEEGTSESATPESGPGSEPATSGSETPGTSESATPESGPGSPAGSPTSTEE GSPAGSPTSTEEGTSTEPSEGSAPGTSESATPETAEAAGCGTAEAASGPGTSESATPESG PGTSESATPESGPGSEPATSGSETPGSEPATSGSETPGSPAGSPTSTEEGTSTEPSEGSAP GTSTEPSEGSAPGSEPATSGSETPGTSESATPESGPGTSTEPSEGSAPTAEAAGCGTAEA AR | 200 |
| Seg 9 | ATAEAAGCGTAEAAGSPAGSPTSTEEGTSESATPESGPGTSTEPSEGSAPGSPAGSPTST EEGTSTEPSEGSAPGTSTEPSEGSAPGTSESATPESGPGSEPATSGSETPGSEPATSGSET PGSPAGSPTSTEEGTSESATPESGPGTSTEPSEGSAPGTSTEPSEGSAPGSPAGSPTSTEE GTSTEPSEGSAPGTSTEPSEGSAPGTSESATPESGPGTSTEPSEGSAPGTSESATPESGPG SEPATSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPGTST EPSEGSAPGTSTEPSEGSAPGTSTEPSEGSAPGTSTEPSEGSAPGTSTEPSEGSAPGSPAG SPTSTEEGTSTEPSEGSAPGTSESATPESGPGSEPATSGSETPGTSESATPESGPGSEPATS GSETPGTSESATPESGPGTSTEPSEGSAPGTSESATPESGPGSPAGSPTSTEEGSPAGSPT STEEGSPAGSPTSTEEGTSESATPESGPGTSTEPSEGSAPGTSESATPESGPGSEPATSGS ETPGTSESATPESGPGSEPATSGSETPGTSESATPESGPGTSTEPSEGSAPGSPAGSPTST EEGTSESATPESGPGSEPATSGSETPGTSESATPESGPGSPAGSPTSTEEGSPAGSPTSTE EGTSTEPSEGSAPGTSESATPESGPGTSESATPESGPGTSESATPESGPGSEPATSGSETP GSEPATSGSETPGSPAGSPTSTEEGTSTEPSEGSAPGTSTEPSEGSAPGSEPATSGSETPG TSESATPESGPGTSTEPSEGSAPR | 201 |
| Seg 10 | AGSPAGSPTSTEEGTSESATPESGPGTSTEPSEGSAPGSPAGSPTSTEEGTSTEPSEGSAP GTSTEPSEGSAPGTSESATPESGPGSEPATSGSETPGSEPATSGSETPGSPAGSPTSTEEG TSESATPESGPGTSTEPSEGSAPGTSTEPSEGSAPGSPAGSPTSTEEGTSTEPSEGSAPGT STEPSEGSAPGTSESATPESGPGTSTEPSEGSAPGTSESATPESGPGSEPATSGSETPGTS | 202 |

TABLE 3-continued

Cysteine- and lysine-engineered XTEN

| Name | Amino Acid Sequence | SEQ ID NO: |
|---|---|---|
| | TEPSEGSAPGTSTEPSEGSAPGTSESATPESGPGTSESATPESGPGSPAGSPTSTEEGTSE<br>SATPESGPGSEPATSGSETPGTSESATPESGPGTSTEPSEGSAPGTSTEPSEGSAPGTSTE<br>PSEGSAPGTSTEPSEGSAPGTSTEPSEGSAPGTSTEPSEGSAPGSPAGSPTSTEEGTSTEPS<br>EGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTS<br>TEEGTSESATPESGPGTSTEPSEGSAPGTSESATPESGPGSEPATSGSETPGTSESATPES<br>GPGSEPATSGSETPGTSESATPESGPGTSTEPSEGSAPGSPAGSPTSTEEGTSESATPESG<br>PGSEPATSGSETPGTSESATPESGPGSPAGSPTSTEEGSPAGSPTSTEEGTSTEPSEGSAP<br>GTSESATPESGPGTSESATPESGPGSPAGSPTSTEEGSPAGSPTSTEEGSPAGSETPG<br>SPAGSPTSTEEGTSTEPSEGSAPGTSTEPSEGSAPGSEPATSGSETPGTSESATPESGPGT<br>STEPSEGSAPTAEAAGCGTAEAAR | |
| Seg 11 | ATAEAAGCGTAEAAGSPAGSPTSTEEGTSESATPESGPGTSTEPSEGSAPGSPAGSPTST<br>EEGTSTEPSEGSAPGTSTEPSEGSAPGTSESATPESGPGSEPATSGSETPGSEPATSGSET<br>PGSPAGSPTSTEEGTSESATPESGPGTSTEPSEGSAPGTSTEPSEGSAPGSPAGSPTSTEE<br>GTSTEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGTSESATPESGPSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPTAEAAGCGTAEAAGTSESATPESGPGSEPATSGSETPGTSE<br>SATPESGPGSEPATSGSETPGTSESATPESGPGTSTEPSEGSAPGTSESATPESGPGSPA<br>SPTSTEEGSPAGSPTSTEEGSPAGSPTSTEEGTSESATPESGPGTSTEPSEGSAPGTSESAT<br>PESGPGSEPATSGSETPGTSESATPESGPGSEPATSGSETPGTSESATPESGPGTSTEPSE<br>GSAPGSPAGSPTSTEEGTSESATPESGPGSEPATSGSETPGTSESATPESGPGSPAGSPTS<br>TEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSA<br>PGSEPATSGSETPGTSESATPESGPGTSTEPSEGSAPR | 203 |
| Seg 12 | AGSPAGSPTSTEEGTSESATPESGPGTSTEPSEGSAPGSPAGSPTSTEEGTSTEPSEGSAP<br>GTSTEPSEGSAPGTSESATPESGPGSEPATSGSETPGSEPATSGSETPGSPAGSPTSTEEG<br>TSESATPESGPGTSTEPSEGSAPGTSTEPSEGSAPGSPAGSPTSTEEGTSTEPSEGSAPGT<br>STEPSEGSAPGTSESATPESGPGTSTEPSEGSAPGTSESATPESGPGSEPATSGSETPGTS<br>TEPSEGSAPGTSTEPSEGSAPGTSESATPESGPGTSESATPESGPGSPAGSPTSTEEGTSE<br>SATPESGPGSEPATSGSETPGTSESATPESGPGTSTEPSEGSAPGTSTEPSEGSAPGTSTE<br>PSEGSAPGTSTEPSEGSAPGTSTEPSEGSAPGTSTTAEAAGCGTAEAAEPSEGSAPGSPA<br>GSPTSTEEGTSTEPSEGSAPGTSESATPESGPGSEPATTAEAAGCGTAEAASGSETPGTS<br>ESATPESGPGSEPATSGSETPGTSESATPESGPGTSTEPSEGSAPGTSESATPESGPGSPA<br>GSPTSTEEGSPAGSPTSTEEGSPAGSPTSTEEGTSESATPESGPGTSTEPSEGSAPGTSES<br>ATPESGPGSEPATSGSETPGTSESATPESGPGSEPATSGSETPGTSESATPESGPGTSTEP<br>SEGSAPGSPAGSPTSTEEGTSESATPESGPGSEPATSGSETPGTSESATPESGPGSPAGSP<br>TSTEEGSPAGSPTSTEEGTSTEPSEGSAPGTSESATPESGPGTSESATPESGPGTSESATP<br>ESGPGSEPATSGSETPGSEPATSGSETPGSPAGSPTSTEEGTSTEPSEGSAPGTSTEPSEG<br>SAPGSEPATSGSETPGTSESATPESGPGTSTEPSEGSAPR | 204 |
| Seg 13 | AGSPAGSPTSTEEGTSESATPESGPGTSTEPSEGSAPGSPAGSPTSTEEGTSTEPSEGSAP<br>GTSTEPSEGSAPGTSESATPESGPGSEPATSGSETPGSEPATSGSETPGSPAGSPTSTEEG<br>TSESATPESGPGTSTEPSEGSAPGTSTEPSEGSAPGSPAGSPTSTEEGTSTEPSEGSAPGT<br>STEPSEGSAPGTSESATPESGPGTSTEPSEGSAPGTSESATPESGPGSEPATSGSETPGTS<br>TEPSEGSAPGTSTEPSEGSAPGTSESATPESGPGTSESATPESGPGSPAGSPTSTEEGTSE<br>SATPESGPGSEPATSGSETPGTSESATPESGPGTSTEPSEGSAPGTSTEPSEGSAPGTSTE<br>PSEGSAPGTSTEPSEGSAPGTSTEPSEGSAPGTSTEPSEGSAPGSPAGSPTSTEEGTSTEPS<br>EGSAPTAEAAGCGTAEAAGTSESATPESGPGSEPATSGSETPGTSESATPESGPGSEPAT<br>SGSETPGTSESATPESGPGTSTEPSEGSAPGTSESATPESGPGSPAGSPTSTEEGSPAGSP<br>TSTEEGSPAGSPTSTEEGTSESATPESGPGTSTEPSEGSAPGTSESATPESGPGSEPATSG<br>SETPGTSESATPESGPGSEPATSGSETPGTSESATPESGPGTSTEPSEGSAPGSPAGSPTST<br>EEGTSESATPESGPGSEPATSGSETPGTSESATPESGPGSPAGSPTSTEEGSPAGSPTSTE<br>EGTSTEPSEGSAPGTSESATPESGPGTSESATPESGPGTSESATPESGPGSEPATSGSETP<br>GSEPATSGSETPGSPAGSPTSTEEGTSTEPSEGSAPGTSTEPSEGSAPGSEPATSGSETPG<br>TSESATPESGPGTSTEPSEGSAPTAEAAGCGTAEAAR | 205 |
| Seg 14 | AGSPAGSPTSTEEGTSESATPESGPGTSTEPSEGSAPGSPAGSPTSTEEGTSTEPSEGSAP<br>GTSTEPSEGSAPGTSESATPESGPGSEPATSGSETPGSEPATSGSETPGSPAGSPTSTEEG<br>TSESATPESGPGTSTEPSEGSAPGTSTEPSEGSAPGSPAGSPTSTEEGTSTEPSEGSAPGT<br>STEPSEGSAPGTSESATPESGPGTSTEPSEGSAPGTSESATPESGPGSEPATSGSETPGTS<br>TEPSEGSAPGTSTEPSEGSAPGTSESATPESGPGTSESATPESGPGSPAGSPTSTEEGTSE<br>SATPESGPGSEPATSGSETPGTSESATPESGPGTSTEPSEGSAPGTSTEPSEGSAPGTSTE<br>PSEGSAPGTSTEPSEGSAPGTSTEPSEGSAPGTSTEPSEGSAPGSPAGSPTSTEEGTSTEPS<br>EGSAPGGKPGGTSESATPESGPGSEPATSGSETPGTSESATPESGPGSEPATSGSETPGTS<br>ESATPESGPGTSTEPSEGSAPGTSESATPESGPGSPAGSPTSTEEGSPAGSPTSTEEGSPA<br>GSPTSTEEGTSESATPESGPGTSTEPSEGSAPGTSESATPESGPGSEPATSGSETPGTSES<br>ATPESGPGSEPATSGSETPGTSESATPESGPGTSTEPSEGSAPGSPAGSPTSTEEGTSESA<br>TPESGPGSEPATSGSETPGTSESATPESGPGSPAGSPTSTEEGSPAGSPTSTEEGTSTEPSE<br>GSAPGTSESATPESGPGTSESATPESGPGTSESATPESGPGSEPATSGSETPGSEPATSGS<br>ETPGSPAGSPTSTEEGTSTEPSEGSAPGTSTEPSEGSAPGSEPATSGSETPGTSESATPES<br>GPGTSTEPSEGSAPR | 206 |

TABLE 3-continued

Cysteine- and lysine-engineered XTEN

| Name | Amino Acid Sequence | SEQ ID NO: |
|---|---|---|
| Seg 15 | AGGKPGGSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPSEGS APGTSTEPSEGSAPGTSESATPESGPGTSTEPSEGSAPGTSESATPESGPGSEPATSGSET PGTSTEPSEGSAPGTSTEPSEGSAPGTSESATPESGPGTSESATPESGPGSPAGSPTSTEE GTSESATPESGPGSEPATSGSETPGTSESATPESGPGTSTEPSEGSAPGTSTEPSEGSAPG TSTEPSEGSAPGTSTEPSEGSAPGTSTEPSEGSAPGTSTEPSEGSAPGSPAGSPTSTEEGT STEPSEGSAPGTSESATPESGPGSEPATSGSETPGTSESATPESGPGSEPATSGSETPGTS ESATPESGPGTSTEPSEGSAPGTSESATPESGPGSPAGSPTSTEEGSPAGSPTSTEEGSPA GSPTSTEEGTSESATPESGPGTSTEPSEGSAPGTSESATPESGPGSEPATSGSETPGTSES ATPESGPGSEPATSGSETPGTSESATPESGPGTSTEPSEGSAPGSPAGSPTSTEEGTSESA TPESGPGSEPATSGSETPGTSESATPESGPGSPAGSPTSTEEGSPAGSPTSTEEGTSTEPSE GSAPGTSESATPESGPGTSESATPESGPGTSESATPESGPGSEPATSGSETPGSEPATSGS ETPGSPAGSPTSTEEGTSTEPSEGSAPGTSTEPSEGSAPGSEPATSGSETPGTSESATPES GPGTSTEPSEGSAPGGKPGR | 207 |
| Seg 16 | AGGKPGGSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPSEGS APGTSTEPSEGSAPGTSESATPESGPGTSTEPSEGSAPGTSESATPESGPGSEPATSGSET PGTSTEPSEGSAPGTSTEPSEGSAPGTSESATPESGPGTSESATPESGPGSPAGSPTSTEE GTSESATPESGPGSEPATSGSETPGTSESATPESGPGTSTEPSEGSAPGTSTEPSEGSAPG TSTEPSEGSAPGTSTEPSEGSAPGTSTEPSEGSAPGTSTEPSEGSAPGSPAGSPTSTEEGT STEPSEGSAPGGKPGGTSESATPESGPGSEPATSGSETPGTSESATPESGPGSEPATSGSE TPGTSESATPESGPGTSTEPSEGSAPGTSESATPESGPGSPAGSPTSTEEGSPAGSPTSTE EGSPAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTSTEEG TSESATPESGPGSEPATSGSETPGTSESATPESGPGSPAGSPTSTEEGSPAGSPTSTEEGT STEPSEGSAPGTSESATPESGPGTSESATPESGPGTSESATPESGPGSEPATSGSETPGSEP ATSGSETPGSPAGSPTSTEEGTSTEPSEGSAPGTSTEPSEGSAPGSEPATSGSETPGTSES ATPESGPGTSTEPSEGSAPGGKPGR | 208 |
| Seg 17 | AGGKPGGSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPSEGS APGTSTEPSEGSAPGTSESATPESGPGTSTEPSEGSAPGTSESATPESGPGSEPATSGSET PGTSTEPSEGSAPGTSTEPSEGSAPGTSESATPESGPGTSESATPESGPGGKPGGSPAGSP TSTEEGTSESATPESGPGSEPATSGSETPGTSESATPESGPGTSTEPSEGSAPGTSTEPSE GSAPGTSTEPSEGSAPGTSTEPSEGSAPGTSTEPSEGSAPGTSTEPSEGSAPGSPAGSPTS TEEGTSTEPSEGSAPGTSESATPESGPGSEPATSGSETPGTSESATPESGPGSEPATSGSE TPGTSESATPESGPGTSTEPSEGSAPGTSESATPESGPGSPAGSPTSTEEGSPAGSPTSTE EGSPAGSPTSTEEGTSESATPESGPGTSTEPSEGSAPGGKPGGTSESATPESGPGSEPATS GSETPGTSESATPESGPGSEPATSGSETPGTSESATPESGPGTSTEPSEGSAPGSPAGSPT STEEGTSESATPESGPGSEPATSGSETPGTSESATPESGPGSPAGSPTSTEEGSPAGSPTS TEEGTSTEPSEGSAPGTSESATPESGPGTSESATPESGPGTSESATPESGPGSEPATSGSE TPGSEPATSGSETPGSPAGSPTSTEEGTSTEPSEGSAPGTSTEPSEGSAPGSEPATSGSET PGTSESATPESGPGTSTEPSEGSAPGGKPGR | 209 |
| Seg 18 | AGGKPGGSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPSEGS APGTSTEPSEGSAPGTSESATPESGPGTSTEPSEGSAPGGKPGGTSESATPESGPGSEPAT SGSETPGTSTEPSEGSAPGTSTEPSEGSAPGTSESATPESGPGTSESATPESGPGSPAGSP TSTEEGTSESATPESGPGSEPATSGSETPGTSESATPESGPGTSTEPSEGSAPGTSTEPSE GSAPGTSTEPSEGSAPGTSTEPSEGSAPGTSTEPSEGSAPGTSTEPSEGSAPGSPAGSPTS TEEGTSTEPSEGSAPGGKPGGTSESATPESGPGSEPATSGSETPGTSESATPESGPGSEPA TSGSETPGTSESATPESGPGTSTEPSEGSAPGTSESATPESGPGSPAGSPTSTEEGSPAGS PTSTEEGSPAGSPTSTEEGTSESATPESGPGTSTEPSEGSAPGTSESATPESGPGSEPATS GSETPGTSESATPESGPGSEPATSGSETPGTSESATPESGPGTSTEPSEGSAPGGKPGGSP AGSPTSTEEGTSESATPESGPGSEPATSGSETPGTSESATPESGPGSPAGSPTSTEEGSPA GSPTSTEEGTSTEPSEGSAPGTSESATPESGPGTSESATPESGPGTSESATPESGPGSEPA TSGSETPGSEPATSGSETPGSPAGSPTSTEEGTSTEPSEGSAPGTSTEPSEGSAPGSEPAT SGSETPGTSESATPESGPGTSTEPSEGSAPGGKPGR | 210 |
| Seg 19 | AGGKPGGSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEGGKP GPSEGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSPAGS PTSTEEGTSESATPESGPGSEPATSGSETPGTSESATPESGPGTSTEPSEGSGGKPGAPGT STEPSEGSAPGTSTEPSEGSAPGTSTEPSEGSAPGTSTEPSEGSAPGTSTEPSEGSTEPSE AGSPTSTEEGTSTEPSEGSAPGTSESATPESGPGSEPATSGSETPGTSESATPESGPGSEP ATSGSETPGTSESATPESGPGTSTEPSEGSAPGTSESATPESGPGSGGKPGPAGSPTSTEE GSPAGSPTSTEEGSPAGSPTSTEEGTSESATPESGPGTSTEPSEGSAPGTSESATPESGPG SEPATSGSETPGTSESATPESGPGSEPATSGSETPGTSESATPESGPGTSTEPSEGSAPGSP AGSPTSTEEGTSESATPESGPGSEPATSGSETPGTSESATPESGPGTSTEPSEGSAPGGKPGPESGPGSPAGSPTSTE | 211 |

TABLE 3-continued

Cysteine- and lysine-engineered XTEN

| Name | Amino Acid Sequence | SEQ ID NO: |
|---|---|---|
| | EGSPAGSPTSTEEGTSTEPSEGSAPGTSESATPESGPGTSESATPESGPGTSESATPESGP GSEPATSGSETPGSEPATSGSETPGSPAGSPTSTEEGTSTEPSEGSAPGTSTEPSEGSAPG SEPATSGSETPGTSESATPESGPGTSTEPSEGSAPGGKPGR | |
| Seg 20 | AGGKPGGSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGSPAGSPT STEEGTSESATPESGPGTSTEPSEGSAPGGKPGGTSTEPSEGSAPGSPAGSPTSTEEGTST EPSEGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGGKPGG SPAGSPTSTEEGTSESATPESGPGSEPATSGSETPGTSESATPESGPGTSTEPSEGSAPGT STEPSEGSAPGTSTEPSEGSAPGTSTEPSEGSAPGTSTEPSEGSAPGTSTEPSEGSAPGSP AGSPTSTEEGTSTEPSEGSAPGGKPGGTSESATPESGPGSEPATSGSETPGTSESATPESG PGSEPATSGSETPGTSESATPESGPGTSTEPSEGSAPGTSESATPESGPGSPAGSPTSTEE GSPAGSPTSTEEGSPAGSPTSTEEGTSESATPESGPGTSTEPSEGSAPGGKPGGTSESATP ESGPGSEPATSGSETPGTSESATPESGPGSEPATSGSETPGTSESATPESGPGTSTEPSEG SAPGSPAGSPTSTEEGTSESATPESGPGSEPATSGSETPGTSESATPESGPGSPAGSPTST EEGSPAGSPTSTEEGGKPGGTSTEPSEGSAPGTSESATPESGPGTSESATPESGPGTSESA TPESGPGSEPATSGSETPGSEPATSGSETPGSPAGSPTSTEEGTSTEPSEGSAPGTSTEPSE GSAPGSEPATSGSETPGTSESATPESGPGTSTEPSEGSAPGGKPGR | 212 |
| Seg 21 | AGGKPGGSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGSPAGSPT STEEGTSGGKPGESATPESGPGTSTEPSEGSAPGTSTEPSEGSAPGSPAGSPTSTEEGTST EPSEGSAPGTSTEPSEGSAPGTSESATPESGPGTSTEPSEGSAPGTSESATPESGPGSEPA TSGSETPGTSTEPSGGKPGEGSAPGTSTEPSEGSAPGTSESATPESGPGTSESATPESGPG SPAGSPTSTEEGTSESATPESGPGSEPATSGSETPGTSESATPESGPGTSTEPSEGSAPGT STEPSEGSAPGTSTEPSEGSGGKPGAPGTSTEPSEGSAPGTSTEPSEGSAPGTSTEPSEGS APGSPAGSPTSTEEGTSTEPSEGSAPGTSESATPESGPGSEPATSGSETPGTSESATPESG PGSEPATSGSETPGTSESATPESGPGTGGKPGSTEPSEGSAPGTSESATPESGPGSPAGSP TSTEEGSPAGSPTSTEEGSPAGSPTSTEEGTSESATPESGPGTSTEPSEGSAPGTSESATP ESGPGSEPATSGSETPGTSESATPESGPGSEPAGGKPGTSGSETPGTSESATPESGPGTST EPSEGSAPGSPAGSPTSTEEGTSESATPESGPGSEPATSGSETPGTSESATPESGPGSPAG SPTSTEEGSPAGSPTSTEEGTSTEPSEGSAPGTSESATPEGGKPGSGPGTSESATPESGPG TSESATPESGPGSEPATSGSETPGSEPATSGSETPGSPAGSPTSTEEGTSTEPSEGSAPGT STEPSEGSAPGSEPATSGSETPGTSESATPESGPGTSTEPSEGSAPGGKPGR | 213 |
| Seg 22 | AGGKPGGSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPSEGS APGTSTEPSEGSAPGTSESATPESGPGTSTEPSEGSAPGTSESATPESGPGSEPATSGSET PGTSTEPSEGSAPGTSTEPSEGSAPGTSESATPESGPGTSESATPESGPGSPAGSPTSTEE GTSESATPESGPGSEPATSGSETPGTSESATPESGPGTSTEPSEGSAPGTSTEPSEGSAPG TSTEPSEGSAPGTSTEPSEGSAPGTSTEPSEGSAPGTSTEPSEGSAPGSPAGSPTSTEEGT STEPSEGSAPGTSESATPESGPGSEPATSGSETPGTSESATPESGPGSEPATSGSETPGTS ESATPESGPGTSTEPSEGSAPGTSESATPESGPGSPAGSPTSTEEGSPAGSPTSTEEGSPA GSPTSTEEGTSESATPESGPGTSTEPSEGSAPGTSESATPESGPGSEPATSGSETPGTSES ATPESGPGSEPATSGSETPGTSESATPESGPGTSTEPSEGSAPGSPAGSPTSTEEGTSESA TPESGPGSEPATSGSETPGTSESATPESGPGSPAGSPTSTEEGSPAGSPTSTEEGTSTEPSE GSAPGTSESATPESGPGTSESATPESGPGTSESATPESGPGSEPATSGSETPGSEPATSGS ETPGSPAGSPTSTEEGTSTEPSEGSAPGTSTEPSEGSAPGSEPATSGSETPGTSESATPES GPGTSTEPSEGSAPR | 214 |
| Seg 23 | AGSPAGSPTSTEEGTSESATPESGPGTSTEPSEGSAPGSPAGSPTSTEEGTSTEPSEGSAP GTSTEPSEGSAPGTSESATPESGPGSEPATSGSETPGSEPATSGSETPGSPAGSPTSTEEG TSESATPESGPGTSTEPSEGSAPGTSTEPSEGSAPGSPAGSPTSTEEGTSTEPSEGSAPGT STEPSEGSAPGTSESATPESGPGTSTEPSEGSAPGTSESATPESGPGSEPATSGSETPGTS TEPSEGSAPGTSTEPSEGSAPGTSESATPESGPGTSESATPESGPGSPAGSPTSTEEGTSE SATPESGPGSEPATSGSETPGTSESATPESGPGTSTEPSEGSAPGTSTEPSEGSAPGTSTE PSEGSAPGTSTEPSEGSAPGTSTEPSEGSAPGSPAGSPTSTEEGTSTEPS EGSAPGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAGSPTS TEEGTSESATPESGPGTSTEPSEGSAPGTSESATPESGPGSEPATSGSETPGTSESATPES GPGSEPATSGSETPGTSESATPESGPGTSTEPSEGSAPGSPAGSPTSTEEGTSESATPESG PGSEPATSGSETPGTSESATPESGPGSPAGSPTSTEEGSPAGSPTSTEEGTSTEPSEGSAP GTSESATPESGPGTSESATPESGPGTSESATPESGPGSEPATSGSETPGSEPATSGSETPG SPAGSPTSTEEGTSTEPSEGSAPGTSTEPSEGSAPGSEPATSGSETPGTSESATPESGPGT STEPSEGSAPGGKPGR | 215 |
| Seg 24 | AGGKPGGSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPSEGS APGTSTEPSEGSAPGTSESATPESGPGTSTEPSEGSAPGTSESATPESGPGSEPATSGSET PGTSTEPSEGSAPGTSTEPSEGSAPGTSESATPESGPGTSESATPESGPGSPAGSPTSTEE GTSESATPESGPGSEPATSGSETPGTSESATPESGPGTSTEPSEGSAPGTSTEPSEGSAPG TSTEPSEGSAPGTSTEPSEGSAPGTSTEPSEGSAPGSPAGSPTSTEEGT STEPSEGSAPGGKPGGTSESATPESGPGSEPATSGSETPGTSESATPESGPGSEPATSGSE | 216 |

TABLE 3-continued

Cysteine- and lysine-engineered XTEN

| Name | Amino Acid Sequence | SEQ ID NO: |
|---|---|---|
| | TPGTSESATPESGPGTSTEPSEGSAPGTSESATPESGPGSPAGSPTSTEEGSPAGSPTSTE<br>EGSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEG<br>TSESATPESGPGSEPATSGSETPGTSESATPESGPGSPAGSPTSTEEGSPAGSPTSTEEGT<br>STEPSEGSAPGTSESATPESGPGTSESATPESGPGTSESATPESGPGSEPATSGSETPGSEP<br>ATSGSETPGSPAGSPTSTEEGTSTEPSEGSAPGTSTEPSEGSAPGSEPATSGSETPGTSES<br>ATPESGPGTSTEPSEGSAPR | |
| Seg 25 | AGSPAGSPTSTEEGTSESATPESGPGTSTEPSEGSAPGSPAGSPTSTEEGTSTEPSEGSAP<br>GTSTEPSEGSAPGTSESATPESGPGSEPATSGSETPGSEPATSGSETPGSPAGSPTSTEEG<br>TSESATPESGPGTSTEPSEGSAPGTSTEPSEGSAPGSPAGSPTSTEEGTSTEPSEGSAPGT<br>STEPSEGSAPGTSESATPESGPGTSTEPSEGSAPGTSESATPESGPGSEPATSGSETPGTS<br>TEPSEGSAPGTSTEPSEGSAPGTSESATPESGPGTSESATPESGPGSPAGSPTSTEEGTSE<br>SATPESGPGSEPATSGSETPGTSESATPESGPGTSTEPSEGSAPGTSTEPSEGSAPGTSTE<br>PSEGSAPGTSTEPSEGSAPGTSTEPSEGSAPGTSTGGKPGEPSEGSAPGSPAGSPTSTEEG<br>TSTEPSEGSAPGTSESATPESGPGSEPATGGKPGSGSETPGTSESATPESGPGSEPATSGS<br>ETPGTSESATPESGPGTSTEPSEGSAPGTSESATPESGPGSPAGSPTSTEEGSPAGSPTST<br>EEGSPAGSPTSTEEGTSESATPESGPGTSTEPSEGSAPGTSESATPESGPGSEPATSGSET<br>PGTSESATPESGPGSEPATSGSETPGTSESATPESGPGTSTEPSEGSAPGSPAGSPTSTEE<br>GTSESATPESGPGSEPATSGSETPGTSESATPESGPGSPAGSPTSTEEGSPAGSPTSTEEG<br>TSTEPSEGSAPGTSESATPESGPGTSESATPESGPGTSESATPESGPGSEPATSGSETPGS<br>EPATSGSETPGSPAGSPTSTEEGTSTEPSEGSAPGTSTEPSEGSAPGSEPATSGSETPGTS<br>ESATPESGPGTSTEPSEGSAPR | 217 |
| Seg 26 | AGSPAGSPTSTEEGTSESATPESGPGTSTEPSEGSAPGSPAGSPTSTEEGTSTEPSEGSAP<br>GTSTEPSEGSAPGTSESATPESGPGSEPATSGSETPGSEPATSGSETPGSPAGSPTSTEEG<br>TSESATPESGPGTSTEPSEGSAPGTSTEPSEGSAPGSPAGSPTSTEEGTSTEPSEGSAPGT<br>STEPSEGSAPGTSESATPESGPGTSTEPSEGSAPGTSESATPESGPGSEPATSGSETPGTS<br>TEPSEGSAPGTSTEPSEGSAPGTSESATPESGPGTSESATPESGPGSPAGSPTSTEEGTSE<br>SATPESGPGSEPATSGSETPGTSESATPESGPGTSTEPSEGSAPGTSTEPSEGSAPGTSTE<br>PSEGSAPGTSTEPSEGSAPGTSTEPSEGSAPGTSTEPSEGSAPGSPAGSPTSTEEGTSTEPS<br>EGSAPGGKPGGTSESATPESGPGSEPATSGSETPGTSESATPESGPGSEPATSGSETPGTS<br>ESATPESGPGTSTEPSEGSAPGTSESATPESGPGSPAGSPTSTEEGSPAGSPTSTEEGSPA<br>GSPTSTEEGTSESATPESGPGTSTEPSEGSAPGTSESATPESGPGSEPATSGSETPGTSES<br>ATPESGPGSEPATSGSETPGTSESATPESGPGTSTEPSEGSAPGSPAGSPTSTEEGTSESA<br>TPESGPGSEPATSGSETPGTSESATPESGPGSPAGSPTSTEEGSPAGSPTSTEEGTSTEPSE<br>GSAPGTSESATPESGPGTSESATPESGPGTSESATPESGPGSEPATSGSETPGSEPATSGS<br>ETPGSPAGSPTSTEEGTSTEPSEGSAPGTSTEPSEGSAPGSEPATSGSETPGTSESATPES<br>GPGTSTEPSEGSAPGGKPGR | 218 |
| Seg 27 | AEATTAAGGAGSPAGSPTSTEEGTSESATPESGPGTSTEPSEGSAPGSPAGSPTSTEEGT<br>STEPSEGSAPGTSTEPSEGSAPGTSESATPESGPGSEPATSGSETPGSEPATSGSETPGSP<br>AGSPTSTEEGTSESATPESGPGTSTEPSEGSAPGTSTEPSEGSAPGSPAGSPTSTEEGTST<br>EPSEGSAPGTSTEPSEGSAPGTSESATPESGPGTSTEPSEGSAPGTSESATPESGPGSEPA<br>TSGSETPGTSTEPSEGSAPGTSTEPSEGSAPGTSESATPESGPGTSESATPESGPGSPAGS<br>PTSTEEGTSESATPESGPGSEPATSGSETPGTSESATPESGPGTSTEPSEGSAPGTSTEPSE<br>GSAPGTSTEPSEGSAPGTSTEPSEGSAPGTSTEPSEGSAPGTSTEPSEGSAPGSPAGSPTS<br>TEEGTSTEPSEGSAPTAEAAGCGTAEAAGTSESATPESGPGSEPATSGSETPGTSESATP<br>ESGPGSEPATSGSETPGTSESATPESGPGTSTEPSEGSAPGTSESATPESGPGSPAGSPTS<br>TEEGSPAGSPTSTEEGSPAGSPTSTEEGTSESATPESGPGTSTEPSEGSAPGTSESATPES<br>GPGSEPATSGSETPGTSESATPESGPGSEPATSGSETPGTSESATPESGPGTSTEPSEGSA<br>PGSPAGSPTSTEEGTSESATPESGPGSEPATSGSETPGTSESATPESGPGSPAGSPTSTEE<br>GSPAGSPTSTEEGTSTEPSEGSAPGTSESATPESGPGTSESATPESGPGTSESATPESGPG<br>SEPATSGSETPGSEPATSGSETPGSPAGSPTSTEEGTSTEPSEGSAPGTSTEPSEGSAPGS<br>EPATSGSETPGTSESATPESGPGTSTEPSEGSAPR | 219 |
| Seg 28 | AEATTAAGGATAEAAGCGTAEAAGSPAGSPTSTEEGTSESATPESGPGTSTEPSEGSAP<br>GSPAGSPTSTEEGTSTEPSEGSAPGTSTEPSEGSAPGTSESATPESGPGSEPATSGSETPG<br>SEPATSGSETPGSPAGSPTSTEEGTSESATPESGPGTSTEPSEGSAPGTSTEPSEGSAPGSP<br>AGSPTSTEEGTSTEPSEGSAPGTSTEPSEGSAPGTSESATPESGPGTSTEPSEGSAPGTSE<br>SATPESGPGSEPATSGSETPGTSTEPSEGSAPGTSTEPSEGSAPGTSESATPESGPGTSES<br>ATPESGPGSPAGSPTSTEEGTSESATPESGPGSEPATSGSETPGTSESATPESGPGTSTEP<br>SEGSAPGTSTEPSEGSAPGTSTEPSEGSAPGTSTEPSEGSAPGTSTEPSEGSAPGTSTEPS<br>EGSAPGSPAGSPTSTEEGTSTEPSEGSAPGTSESATPESGPGSEPATSGSETPGTSESATP<br>ESGPGSEPATSGSETPGTSESATPESGPGTSTEPSEGSAPGTSESATPESGPGSPAGSPTS<br>TEEGSPAGSPTSTEEGSPAGSPTSTEEGTSESATPESGPGTSTEPSEGSAPGTSESATPES<br>GPGSEPATSGSETPGTSESATPESGPGSEPATSGSETPGTSESATPESGPGTSTEPSEGSA<br>PGSPAGSPTSTEEGTSESATPESGPGSEPATSGSETPGTSESATPESGPGSPAGSPTSTEE<br>GSPAGSPTSTEEGTSTEPSEGSAPGTSESATPESGPGTSESATPESGPGTSESATPESGPG<br>SEPATSGSETPGSEPATSGSETPGSPAGSPTSTEEGTSTEPSEGSAPGTSTEPSEGSAPGS<br>EPATSGSETPGTSESATPESGPGTSTEPSEGSAPTAEAAGCGTAEAAR | 220 |
| Seg 29 | AEATTAAGGATAEAAGCGTAEAAGSPAGSPTSTEEGTSESATPESGPGTSTEPSEGSAP<br>GSPAGSPTSTEEGTSTEPSEGSAPGTSTEPSEGSAPGTSESATPESGPGSEPATSGSETPG<br>SEPATSGSETPGSPAGSPTSTEEGTSESATPESGPGTSTEPSEGSAPGTSTEPSEGSAPGSP<br>AGSPTSTEEGTSTEPSEGSAPGTSTEPSEGSAPGTSESATPESGPGTSTEPSEGSAPGTSE | 221 |

TABLE 3-continued

Cysteine- and lysine-engineered XTEN

| Name | Amino Acid Sequence | SEQ ID NO: |
|---|---|---|
| | SATPESGPGSEPATSGSETPGTSTEPSEGSAPGTSTEPSEGSAPGTSESATPESGPGTSES<br>ATPESGPGSPAGSPTSTEEGTSESATPESGPGSEPATSGSETPGTSESATPESGPGTSTEP<br>SEGSAPGTSTEPSEGSAPGTSTEPSEGSAPGTSTEPSEGSAPGTSTEPSEGSAPGTSTEPS<br>EGSAPGSPAGSPTSTEEGTSTEPSEGSAPTAEAAGCGTAEAAGTSESATPESGPGSEPAT<br>SGSETPGTSESATPESGPGSEPATSGSETPGTSESATPESGPGTSTEPSEGSAPGTSESAT<br>PESGPGSPAGSPTSTEEGSPAGSPTSTEEGSPAGSPTSTEEGTSESATPESGPGTSTEPSE<br>GSAPGTSESATPESGPGSEPATSGSETPGTSESATPESGPGSEPATSGSETPGTSESATPE<br>SGPGTSTEPSEGSAPGSPAGSPTSTEEGTSESATPESGPGSEPATSGSETPGTSESATPES<br>GPGSPAGSPTSTEEGSPAGSPTSTEEGTSTEPSEGSAPGTSESATPESGPGTSESATPESG<br>PGTSESATPESGPGSEPATSGSETPGSEPATSGSETPGSPAGSPTSTEEGTSTEPSEGSAP<br>GTSTEPSEGSAPGSEPATSGSETPGTSESATPESGPGTSTEPSEGSAPTAEAAGCGTAEA<br>AR | |
| Seg 30 | AEATTAAGGATAEAAGCGTAEAAGSPAGSPTSTEEGTSESATPESGPGTSTEPSEGSAP<br>GSPAGSPTSTEEGTSTEPSEGSAPGTSTEPSEGSAPGTSESATPESGPGSEPATSGSETPG<br>SEPATSGSETPGSPAGSPTSTEEGTSESATPESGPGTSTEPSEGSAPGTSTEPSEGSAPGSP<br>AGSPTSTEEGTSTEPSEGSAPGTSTEPSEGSAPGTSESATPESGPGTSTEPSEGSAPGTSE<br>SATPESGPGSEPATSGSETPGTSTEPSEGSAPGTSTEPSEGSAPGTSESATPESGPGTSES<br>ATPESGPTAEAAGCGTAEAAGSPAGSPTSTEEGTSESATPESGPGSEPATSGSETPGTSE<br>SATPESGPGTSTEPSEGSAPGTSTEPSEGSAPGTSTEPSEGSAPGTSTEPSEGSAPGTSTE<br>PSEGSAPGTSTEPSEGSAPGSPAGSPTSTEEGTSTEPSEGSAPGTSESATPESGPGSEPAT<br>SGSETPGTSESATPESGPGSEPATSGSETPGTSESATPESGPGTSTEPSEGSAPGTSESAT<br>PESGPGSPAGSPTSTEEGSPAGSPTSTEEGSPAGSPTSTEEGTSESATPESGPGTSTEPSE<br>GSAPTAEAAGCGTAEAAGTSESATPESGPGSEPATSGSETPGTSESATPESGPGSEPATS<br>GSETPGTSESATPESGPGTSTEPSEGSAPGSPAGSPTSTEEGTSESATPESGPGSEPATSG<br>SETPGTSESATPESGPGSPAGSPTSTEEGSPAGSPTSTEEGTSTEPSEGSAPGTSESATPES<br>GPGTSESATPESGPGTSESATPESGPGSEPATSGSETPGSEPATSGSETPGSPAGSPTSTE<br>EGTSTEPSEGSAPGTSTEPSEGSAPGSEPATSGSETPGTSESATPESGPGTSTEPSEGSAP<br>TAEAAGCGTAEAAR | 222 |
| Seg 31 | ATGTATSEGSPEGSPAGSPTSTEEGTSESATPESGPGTSTEPSEGSAPGSPAGSPTSTEEG<br>TSTEPSEGSAPGTSTEPSEGSAPGTSESATPESGPGSEPATSGSETPGSEPATSGSETPGSP<br>AGSPTSTEEGTSESATPESGPGTSTEPSEGSAPGTSTEPSEGSAPGSPAGSPTSTEEGTST<br>EPSEGSAPGTSTEPSEGSAPGTSESATPESGPGTSTEPSEGSAPGTSESATPESGPGSEPA<br>TSGSETPGTSTEPSEGSAPGTSTEPSEGSAPGTSESATPESGPGTSESATPESGPGSPAGS<br>PTSTEEGTSESATPESGPGSEPATSGSETPGTSESATPESGPGTSTEPSEGSAPGTSTEPSE<br>GSAPGTSTEPSEGSAPGTSTEPSEGSAPGTSTEPSEGSAPGTSTEPSEGSAPGSPAGSPTS<br>TEEGTSTEPSEGSAPTAEAAGCGTAEAAGTSESATPESGPGSEPATSGSETPGTSESATP<br>ESGPGSEPATSGSETPGTSESATPESGPGTSTEPSEGSAPGTSESATPESGPGSPAGSPTS<br>TEEGSPAGSPTSTEEGSPAGSPTSTEEGTSESATPESGPGTSTEPSEGSAPGTSESATPES<br>GPGSEPATSGSETPGTSESATPESGPGSEPATSGSETPGTSESATPESGPGTSTEPSEGSA<br>PGSPAGSPTSTEEGTSESATPESGPGSEPATSGSETPGTSESATPESGPGSPAGSPTSTEE<br>GSPAGSPTSTEEGTSTEPSEGSAPGTSESATPESGPGTSESATPESGPGTSESATPESGPG<br>SEPATSGSETPGSEPATSGSETPGSPAGSPTSTEEGTSTEPSEGSAPGTSTEPSEGSAPGS<br>EPATSGSETPGTSESATPESGPGTSTEPSEGSAPR | 223 |
| Seg 32 | ATGTATSEGSPETAEAAGCGTAEAAGSPAGSPTSTEEGTSESATPESGPGTSTEPSEGS<br>APGSPAGSPTSTEEGTSTEPSEGSAPGTSTEPSEGSAPGTSESATPESGPGSEPATSGSET<br>PGSEPATSGSETPGSPAGSPTSTEEGTSESATPESGPGTSTEPSEGSAPGTSTEPSEGSAP<br>GSPAGSPTSTEEGTSTEPSEGSAPGTSTEPSEGSAPGTSESATPESGPGTSTEPSEGSAPG<br>TSESATPESGPGSEPATSGSETPGTSTEPSEGSAPGTSTEPSEGSAPGTSESATPESGPGT<br>SESATPESGPGSPAGSPTSTEEGTSESATPESGPGSEPATSGSETPGTSESATPESGPGTS<br>TEPSEGSAPGTSTEPSEGSAPGTSTEPSEGSAPGTSTEPSEGSAPGTSTEPSEGSAPGTST<br>EPSEGSAPGSPAGSPTSTEEGTSTEPSEGSAPGTSESATPESGPGSEPATSGSETPGTSES<br>ATPESGPGSEPATSGSETPGTSESATPESGPGTSTEPSEGSAPGTSESATPESGPGSPAGS<br>PTSTEEGSPAGSPTSTEEGSPAGSPTSTEEGTSESATPESGPGTSTEPSEGSAPGTSESATP<br>ESGPGSEPATSGSETPGTSESATPESGPGSEPATSGSETPGTSESATPESGPGTSTEPSEG<br>SAPGSPAGSPTSTEEGTSESATPESGPGSEPATSGSETPGTSESATPESGPGSPAGSPTST<br>EEGSPAGSPTSTEEGTSTEPSEGSAPGTSESATPESGPGTSESATPESGPGTSESATPESG<br>PGSEPATSGSETPGSEPATSGSETPGSPAGSPTSTEEGTSTEPSEGSAPGTSTEPSEGSAP<br>GSEPATSGSETPGTSESATPESGPGTSTEPSEGSAPTAEAAGCGTAEAAR | 224 |
| Seg 33 | ATGTATSEGSPETAEAAGCGTAEAAGSPAGSPTSTEEGTSESATPESGPGTSTEPSEGS<br>APGSPAGSPTSTEEGTSTEPSEGSAPGTSTEPSEGSAPGTSESATPESGPGSEPATSGSET<br>PGSEPATSGSETPGSPAGSPTSTEEGTSESATPESGPGTSTEPSEGSAPGTSTEPSEGSAP<br>GSPAGSPTSTEEGTSTEPSEGSAPGTSTEPSEGSAPGTSESATPESGPGTSTEPSEGSAPG<br>TSESATPESGPGSEPATSGSETPGTSTEPSEGSAPGTSTEPSEGSAPGTSESATPESGPGT<br>SESATPESGPGSPAGSPTSTEEGTSESATPESGPGSEPATSGSETPGTSESATPESGPGTS<br>TEPSEGSAPGTSTEPSEGSAPGTSTEPSEGSAPGTSTEPSEGSAPGTSTEPSEGSAPGTST<br>EPSEGSAPGSPAGSPTSTEEGTSTEPSEGSAPTAEAAGCGTAEAAGTSESATPESGPGSE<br>PATSGSETPGTSESATPESGPGSEPATSGSETPGTSESATPESGPGTSTEPSEGSAPGTSE<br>SATPESGPGSPAGSPTSTEEGSPAGSPTSTEEGSPAGSPTSTEEGTSESATPESGPGTSTE<br>PSEGSAPGTSESATPESGPGSEPATSGSETPGTSESATPESGPGSEPATSGSETPGTSESA<br>TPESGPGTSTEPSEGSAPGSPAGSPTSTEEGTSESATPESGPGSEPATSGSETPGTSESAT<br>PESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEG | 225 |

TABLE 3-continued

Cysteine- and lysine-engineered XTEN

| Name | Amino Acid Sequence | SEQ ID NO: |
|---|---|---|
| | SAPGTSTEPSEGSAPGSEPATSGSETPGTSESATPESGPGTSTEPSEGSAPTAEAAGCGT<br>AEAAR | |
| Seg 34 | ATGTATSEGSPETAEAAGCGTAEAAGSPAGSPTSTEEGTSESATPESGPGTSTEPSEGS<br>APGSPAGSPTSTEEGTSTEPSEGSAPGTSTEPSEGSAPGTSESATPESGPGSEPATSGSET<br>PGSEPATSGSETPGSPAGSPTSTEEGTSESATPESGPGTSTEPSEGSAPGTSTEPSEGSAP<br>GSPAGSPTSTEEGTSTEPSEGSAPGTSTEPSEGSAPGTSESATPESGPGTSTEPSEGSAPG<br>TSESATPESGPGSEPATSGSETPGTSTEPSEGSAPGTSTEPSEGSAPGTSESATPESGPGT<br>SESATPESGPTAEAAGCGTAEAAGSPAGSPTSTEEGTSESATPESGPGSEPATSGSETPG<br>TSESATPESGPGTSTEPSEGSAPGTSTEPSEGSAPGTSTEPSEGSAPGTSTEPSEGSAPGT<br>STEPSEGSAPGTSTEPSEGSAPGSPAGSPTSTEEGTSTEPSEGSAPGTSESATPESGPGSEP<br>ATSGSETPGTSESATPESGPGSEPATSGSETPGTSESATPESGPGTSTEPSEGSAPGTSES<br>ATPESGPGSPAGSPTSTEEGSPAGSPTSTEEGSPAGSPTSTEEGTSESATPESGPGTSTEP<br>SEGSAPTAEAAGCGTAEAAGTSESATPESGPGSEPATSGSETPGTSESATPESGPGSEPA<br>TSGSETPGTSESATPESGPGTSTEPSEGSAPGSPAGSPTSTEEGTSESATPESGPGSEPAT<br>SGSETPGTSESATPESGPGSPAGSPTSTEEGSPAGSPTSTEEGTSTEPSEGSAPGTSESAT<br>PESGPGTSESATPESGPGTSESATPESGPGSPAGSPTSTEEGTSESATPESGPGSEPATSGSETPGSEPATSGSETPGSPAGSPT<br>STEEGTSTEPSEGSAPGSEPATSGSETPGTSESATPESGPGTSTEPSEGS<br>APTAEAAGCGTAEAAR | 226 |
| Seg 35 | EPTAATTGESAGGSPAGSPTSTEEGTSESATPESGPGTSTEPSEGSAPGSPAGSPTSTEEG<br>TSTEPSEGSAPGTSTEPSEGSAPGTSESATPESGPGSEPATSGSETPGSEPATSGSETPGSP<br>AGSPTSTEEGTSESATPESGPGTSTEPSEGSAPGTSTEPSEGSAPGSPAGSPTSTEEGTST<br>EPSEGSAPGTSTEPSEGSAPGTSESATPESGPGTSTEPSEGSAPGTSESATPESGPGSEPA<br>TSGSETPGTSTEPSEGSAPGTSTEPSEGSAPGTSESATPESGPGSPAGS<br>PTSTEEGTSESATPESGPGSEPATSGSETPGTSESATPESGPGTSTEPSEGSAPGTSTEPSE<br>GSAPGTSTEPSEGSAPGTSTEPSEGSAPGTSTEPSEGSAPGSPAGSPTS<br>TEEGTSTEPSEGSAPTAEAAGCGTAEAAGTSESATPESGPGSEPATSGSETPGTSESATP<br>ESGPGSEPATSGSETPGTSESATPESGPGTSTEPSEGSAPGTSESATPESGPGSPAGSPTS<br>TEEGSPAGSPTSTEEGSPAGSPTSTEEGTSESATPESGPGTSTEPSEGSAPGTSESATPES<br>GPGSEPATSGSETPGTSESATPESGPGSEPATSGSETPGTSESATPESGPGTSTEPSEGSA<br>PGSPAGSPTSTEEGTSESATPESGPGSEPATSGSETPGTSESATPESGPGSPAGSPTSTEE<br>GSPAGSPTSTEEGTSTEPSEGSAPGTSESATPESGPGTSESATPESGPGTSESATPESGPG<br>SEPATSGSETPGSEPATSGSETPGSPAGSPTSTEEGTSTEPSEGSAPGTSTEPSEGSAPGS<br>EPATSGSETPGTSESATPESGPGTSTEPSEGSAPR | 227 |
| Seg 36 | EPTAATTGESAGTAEAAGCGTAEAAGSPAGSPTSTEEGTSESATPESGPGTSTEPSEGS<br>APGSPAGSPTSTEEGTSTEPSEGSAPGTSTEPSEGSAPGTSESATPESGPGSEPATSGSET<br>PGSEPATSGSETPGSPAGSPTSTEEGTSESATPESGPGTSTEPSEGSAPGTSTEPSEGSAP<br>GSPAGSPTSTEEGTSTEPSEGSAPGTSTEPSEGSAPGTSESATPESGPGTSTEPSEGSAPG<br>TSESATPESGPGSEPATSGSETPGTSTEPSEGSAPGTSTEPSEGSAPGTSESATPESGPGT<br>SESATPESGPGSPAGSPTSTEEGTSESATPESGPGSEPATSGSETPGTSESATPESGPGTS<br>TEPSEGSAPGTSTEPSEGSAPGTSTEPSEGSAPGTSTEPSEGSAPGTSTEPSEGSAPGTST<br>EPSEGSAPGSPAGSPTSTEEGTSTEPSEGSAPGTSESATPESGPGSEPATSGSETPGTSES<br>ATPESGPGSEPATSGSETPGTSESATPESGPGTSTEPSEGSAPGTSESATPESGPGSPAGS<br>PTSTEEGSPAGSPTSTEEGSPAGSPTSTEEGTSESATPESGPGTSTEPSEGSAPGTSESATP<br>ESGPGSEPATSGSETPGTSESATPESGPGSEPATSGSETPGTSESATPESGPGTSTEPSEG<br>SAPGSPAGSPTSTEEGTSESATPESGPGSEPATSGSETPGTSESATPESGPGSPAGSPTST<br>EEGSPAGSPTSTEEGTSTEPSEGSAPGTSESATPESGPGTSESATPESGPGTSESATPESG<br>PGSEPATSGSETPGSEPATSGSETPGSPAGSPTSTEEGTSTEPSEGSAPGTSTEPSEGSAP<br>GSEPATSGSETPGTSESATPESGPGTSTEPSEGSAPTAEAAGCGTAEAAR | 228 |
| Seg 37 | EPTAATTGESAGTAEAAGCGTAEAAGSPAGSPTSTEEGTSESATPESGPGTSTEPSEGS<br>APGSPAGSPTSTEEGTSTEPSEGSAPGTSTEPSEGSAPGTSESATPESGPGSEPATSGSET<br>PGSEPATSGSETPGSPAGSPTSTEEGTSESATPESGPGTSTEPSEGSAPGTSTEPSEGSAP<br>GSPAGSPTSTEEGTSTEPSEGSAPGTSTEPSEGSAPGTSESATPESGPGTSTEPSEGSAPG<br>TSESATPESGPGSEPATSGSETPGTSTEPSEGSAPGTSTEPSEGSAPGTSESATPESGPGT<br>SESATPESGPGSPAGSPTSTEEGTSESATPESGPGSEPATSGSETPGTSESATPESGPGTS<br>TEPSEGSAPGTSTEPSEGSAPGTSTEPSEGSAPGTSTEPSEGSAPGTSTEPSEGSAPGTST<br>EPSEGSAPGSPAGSPTSTEEGTSTEPSEGSAPTAEAAGCGTAEAAGTSESATPESGPGSE<br>PATSGSETPGTSESATPESGPGSEPATSGSETPGTSESATPESGPGTSTEPSEGSAPGTSE<br>SATPESGPGSPAGSPTSTEEGSPAGSPTSTEEGSPAGSPTSTEEGTSESATPESGPGTSTE<br>PSEGSAPGTSESATPESGPGSEPATSGSETPGSEPATSGSETPGTSESA<br>TPESGPGTSTEPSEGSAPGSPAGSPTSTEEGTSESATPESGPGSEPATSGSETPGTSESAT<br>PESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEG<br>SAPGTSTEPSEGSAPGSEPATSGSETPGTSESATPESGPGTSTEPSEGSAPTAEAAGCGT<br>AEAAR | 229 |
| Seg 38 | EPTAATTGESAGTAEAAGCGTAEAAGSPAGSPTSTEEGTSESATPESGPGTSTEPSEGS<br>APGSPAGSPTSTEEGTSTEPSEGSAPGTSTEPSEGSAPGTSESATPESGPGSEPATSGSET<br>PGSEPATSGSETPGSPAGSPTSTEEGTSESATPESGPGTSTEPSEGSAPGTSTEPSEGSAP<br>GSPAGSPTSTEEGTSTEPSEGSAPGTSTEPSEGSAPGTSESATPESGPGTSTEPSEGSAPG<br>TSESATPESGPGSEPATSGSETPGTSTEPSEGSAPGTSTEPSEGSAPGTSESATPESGPGT<br>SESATPESGPTAEAAGCGTAEAAGSPAGSPTSTEEGTSESATPESGPGSEPATSGSETPG<br>TSESATPESGPGTSTEPSEGSAPGTSTEPSEGSAPGTSTEPSEGSAPGTSTEPSEGSAPGT | 230 |

TABLE 3-continued

Cysteine- and lysine-engineered XTEN

| Name | Amino Acid Sequence | SEQ ID NO: |
|---|---|---|
|  | STEPSEGSAPGTSTEPSEGSAPGSPAGSPTSTEEGTSTEPSEGSAPGTSESATPESGPGSEP<br>ATSGSETPGTSESATPESGPGSEPATSGSETPGTSESATPESGPGTSTEPSEGSAPGTSESES<br>ATPESGPGSPAGSPTSTEEGSPAGSPTSTEEGSPAGSPTSTEEGTSESATPESGPGTSTEP<br>SEGSAPTAEAAGCGTAEAAGTSESATPESGPGSEPATSGSETPGTSESATPESGPGSEPA<br>TSGSETPGTSESATPESGPGTSTEPSEGSAPGSPAGSPTSTEEGTSESATPESGPGSEPAT<br>SGSETPGTSESATPESGPGSPAGSPTSTEEGSPAGSPTSTEEGTSTEPSEGSAPGTSESAT<br>PESGPGTSESATPESGPGTSESATPESGPGSEPATSGSETPGSEPATSGSETPGSPAGSPT<br>STEEGTSTEPSEGSAPGTSTEPSEGSAPGSEPATSGSETPGTSESATPESGPGTSTEPSEGS<br>APTAEAAGCGTAEAAR |  |
| Seg 39 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPTAEAAGCGTAEAAGTSESATPESGPGSEPATSGSETPGTSE<br>SATPESGPGSEPATSGSETPGTSESATPESGPGTSTEPSEGSAPGTSESATPESGPGSPAG<br>SPTSTEEGSPAGSPTSTEEGSPAGSPTSTEEGTSESATPESGPGTSTEPSEGSAPGTSESAT<br>PESGPGSEPATSGSETPGTSESATPESGPGSEPATSGSETPGTSESATPESGPGTSTEPSE<br>GSAPGSPAGSPTSTEEGTSESATPESGPGSEPATSGSETPGTSESATPESGPGSPAGSPTS<br>TEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSA<br>PGSEPATSGSETPGTSESATPESGPGTSTEPSEGSAPR | 231 |
| Seg 40 | AEATTAAGGAEEETAEAAGCGTAEAAGSPAGSPTSTEEGTSESATPESGPGTSTEPSEG<br>SAPGSPAGSPTSTEEGTSTEPSEGSAPGTSTEPSEGSAPGTSESATPESGPGSEPATSGSE<br>TPGSEPATSGSETPGSPAGSPTSTEEGTSESATPESGPGTSTEPSEGSAPGTSTEPSEGSA<br>PGSPAGSPTSTEEGTSTEPSEGSAPGTSTEPSEGSAPGTSESATPESGPGTSTEPSEGSAP<br>GTSESATPESGPGSEPATSGSETPGTSTEPSEGSAPGTSTEPSEGSAPGTSESATPESGPG<br>TSESATPESGPGSPAGSPTSTEEGTSESATPESGPGSEPATSGSETPGTSESATPESGPGT<br>STEPSEGSAPGTSTEPSEGSAPGTSTEPSEGSAPGTSTEPSEGSAPGTSTEPSEGSAPGTS<br>TEPSEGSAPGSPAGSPTSTEEGTSTEPSEGSAPGTSESATPESGPGSEPATSGSETPGTSE<br>SATPESGPGSEPATSGSETPGTSESATPESGPGTSTEPSEGSAPGTSESATPESGPGSPAG<br>SPTSTEEGSPAGSPTSTEEGSPAGSPTSTEEGTSESATPESGPGTSTEPSEGSAPGTSESAT<br>PESGPGSEPATSGSETPGTSESATPESGPGSEPATSGSETPGTSESATPESGPGTSTEPSE<br>GSAPGSPAGSPTSTEEGTSESATPESGPGSEPATSGSETPGTSESATPESGPGSPAGSPTS<br>TEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSA<br>PGSEPATSGSETPGTSESATPESGPGTSTEPSEGSAPTAEAAGCGTAEAAR | 232 |
| Seg 41 | AEATTAAGGAEEETAEAAGCGTAEAAGSPAGSPTSTEEGTSESATPESGPGTSTEPSEG<br>SAPGSPAGSPTSTEEGTSTEPSEGSAPGTSTEPSEGSAPGTSESATPESGPGSEPATSGSE<br>TPGSEPATSGSETPGSPAGSPTSTEEGTSESATPESGPGTSTEPSEGSAPGTSTEPSEGSA<br>PGSPAGSPTSTEEGTSTEPSEGSAPGTSTEPSEGSAPGTSESATPESGPGTSTEPSEGSAP<br>GTSESATPESGPGSEPATSGSETPGTSTEPSEGSAPGTSTEPSEGSAPGTSESATPESGPG<br>TSESATPESGPGSPAGSPTSTEEGTSESATPESGPGSEPATSGSETPGTSESATPESGPGT<br>STEPSEGSAPGTSTEPSEGSAPGTSTEPSEGSAPGTSTEPSEGSAPGTSTEPSEGSAPGTS<br>TEPSEGSAPGSPAGSPTSTEEGTSTEPSEGSAPTAEAAGCGTAEAAGTSESATPESGPGS<br>EPATSGSETPGTSESATPESGPGSEPATSGSETPGTSESATPESGPGTSTEPSEGSAPGTS<br>ESATPESGPGSPAGSPTSTEEGSPAGSPTSTEEGSPAGSPTSTEEGTSESATPESGPGTST<br>EPSEGSAPGTSESATPESGPGSEPATSGSETPGTSESATPESGPGSEPATSGSETPGTSES<br>ATPESGPGTSTEPSEGSAPGSPAGSPTSTEEGTSESATPESGPGSEPATSGSETPGTSESA<br>TPESGPGSPAGSPTSTEEGSPAGSPTSTEEGTSTEPSEGSAPGTSESATPESGPGTSESAT<br>PESGPGTSESATPESGPGSEPATSGSETPGSEPATSGSETPGSPAGSPTSTEEGTSTEPSE<br>GSAPGTSTEPSEGSAPGSEPATSGSETPGTSESATPESGPGTSTEPSEGSAPTAEAAGCG<br>TAEAAR | 233 |
| Seg 42 | AEATTAAGGAEEETAEAAGCGTAEAAGSPAGSPTSTEEGTSESATPESGPGTSTEPSEG<br>SAPGSPAGSPTSTEEGTSTEPSEGSAPGTSTEPSEGSAPGTSESATPESGPGSEPATSGSE<br>TPGSEPATSGSETPGSPAGSPTSTEEGTSESATPESGPGTSTEPSEGSAPGTSTEPSEGSA<br>PGSPAGSPTSTEEGTSTEPSEGSAPGTSTEPSEGSAPGTSESATPESGPGTSTEPSEGSAP<br>GTSESATPESGPGSEPATSGSETPGTSTEPSEGSAPGTSTEPSEGSAPGTSESATPESGPG<br>TSESATPESGPTAEAAGCGTAEAAGSPAGSPTSTEEGTSESATPESGPGSEPATSGSETP<br>GTSESATPESGPGTSTEPSEGSAPGTSTEPSEGSAPGTSTEPSEGSAPGTSTEPSEGSAPG<br>TSTEPSEGSAPGTSTEPSEGSAPGSPAGSPTSTEEGTSTEPSEGSAPGTSESATPESGPGS<br>EPATSGSETPGTSESATPESGPGSEPATSGSETPGTSESATPESGPGTSTEPSEGSAPGTS<br>ESATPESGPGSPAGSPTSTEEGSPAGSPTSTEEGSPAGSPTSTEEGTSESATPESGPGTST<br>EPSEGSAPTAEAAGCGTAEAAGTSESATPESGPGSEPATSGSETPGTSESATPESGPGSE<br>PATSGSETPGTSESATPESGPGTSTEPSEGSAPGSPAGSPTSTEEGTSESATPESGPGSE<br>PATSGSETPGSPAGSPTSTEEGSPAGSPTSTEEGTSTEPSEGSAPGTSES<br>ATPESGPGSESATPESGPGTSESATPESGPGSEPATSGSETPGSEPATSGSETPGSPAGS<br>PTSTEEGTSTEPSEGSAPGTSTEPSEGSAPGSEPATSGSETPGTSESATPESGPGTSTEPSE<br>GSAPTAEAAGCGTAEAAR | 234 |

TABLE 3-continued

Cysteine- and lysine-engineered XTEN

| Name | Amino Acid Sequence | SEQ ID NO: |
|---|---|---|
| Seg 43 | ATGTATSEGSPEEEEGSPAGSPTSTEEGTSESATPESGPGTSTEPSEGSAPGSPAGSPTST<br>EEGTSTEPSEGSAPGTSTEPSEGSAPGTSESATPESGPGSEPATSGSETPGSEPATSGSET<br>PGSPAGSPTSTEEGTSESATPESGPGTSTEPSEGSAPGTSTEPSEGSAPGSPAGSPTSTEE<br>GTSTEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPTAEAAGCGTAEAAGTSESATPESGPGSEPATSGSETPGTSE<br>SATPESGPGSEPATSGSETPGTSESATPESGPGTSTEPSEGSAPGTSESATPESGPGSPAG<br>SPTSTEEGSPAGSPTSTEEGSPAGSPTSTEEGTSESATPESGPGTSTEPSEGSAPGTSESAT<br>PESGPGSEPATSGSETPGTSESATPESGPGSEPATSGSETPGTSESATPESGPGTSTEPSE<br>GSAPGSPAGSPTSTEEGTSESATPESGPGSEPATSGSETPGTSESATPESGPGSPAGSPTS<br>TEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSA<br>PGSEPATSGSETPGTSESATPESGPGTSTEPSEGSAPR | 235 |
| Seg 44 | ATGTATSEGSPEEEETAEAAGCGTAEAAGSPAGSPTSTEEGTSESATPESGPGTSTEPSE<br>GSAPGSPAGSPTSTEEGTSTEPSEGSAPGTSTEPSEGSAPGTSESATPESGPGSEPATSGS<br>ETPGSEPATSGSETPGSPAGSPTSTEEGTSESATPESGPGTSTEPSEGSAPGTSTEPSEGS<br>APGSPAGSPTSTEEGTSTEPSEGSAPGTSTEPSEGSAPGTSESATPESGPGTSTEPSEGSA<br>PGTSESATPESGPGSEPATSGSETPGTSTEPSEGSAPGTSTEPSEGSAPGTSESATPESGP<br>GTSESATPESGPGSPAGSPTSTEEGTSESATPESGPGSEPATSGSETPGTSESATPESGPG<br>TSTEPSEGSAPGTSTEPSEGSAPGTSTEPSEGSAPGTSTEPSEGSAPGTSTEPSEGSAPGT<br>STEPSEGSAPGSPAGSPTSTEEGTSTEPSEGSAPGTSESATPESGPGSEPATSGSETPGTS<br>ESATPESGPGSEPATSGSETPGTSESATPESGPGTSTEPSEGSAPGTSESATPESGPGSPA<br>GSPTSTEEGSPAGSPTSTEEGSPAGSPTSTEEGTSESATPESGPGTSTEPSEGSAPGTSES<br>ATPESGPGSEPATSGSETPGTSESATPESGPGSEPATSGSETPGTSESATPESGPGTSTEP<br>SEGSAPGSPAGSPTSTEEGTSESATPESGPGSEPATSGSETPGTSESATPESGPGSPAGSP<br>TSTEEGSPAGSPTSTEEGTSTEPSEGSAPGTSESATPESGPGTSESATPESGPGTSESATP<br>ESGPGSEPATSGSETPGSEPATSGSETPGSPAGSPTSTEEGTSTEPSEGSAPGTSTEPSEG<br>SAPGSEPATSGSETPGTSESATPESGPGTSTEPSEGSAPTAEAAGCGTAEAAR | 236 |
| Seg 45 | ATGTATSEGSPEEEETAEAAGCGTAEAAGSPAGSPTSTEEGTSESATPESGPGTSTEPSE<br>GSAPGSPAGSPTSTEEGTSTEPSEGSAPGTSTEPSEGSAPGTSESATPESGPGSEPATSGS<br>ETPGSEPATSGSETPGSPAGSPTSTEEGTSESATPESGPGTSTEPSEGSAPGTSTEPSEGS<br>APGSPAGSPTSTEEGTSTEPSEGSAPGTSTEPSEGSAPGTSESATPESGPGTSTEPSEGSA<br>PGTSESATPESGPGSEPATSGSETPGTSTEPSEGSAPGTSTEPSEGSAPGTSESATPESGP<br>GTSESATPESGPGSPAGSPTSTEEGTSESATPESGPGSEPATSGSETPGTSESATPESGPG<br>TSTEPSEGSAPGTSTEPSEGSAPGTSTEPSEGSAPGTSTEPSEGSAPGTSTEPSEGSAPGT<br>STEPSEGSAPGSPAGSPTSTEEGTSTEPSEGSAPTAEAAGCGTAEAAGTSESATPESGPG<br>SEPATSGSETPGTSESATPESGPGSEPATSGSETPGTSESATPESGPGTSTEPSEGSAPGT<br>SESATPESGPGSPAGSPTSTEEGSPAGSPTSTEEGSPAGSPTSTEEGTSESATPESGPGTS<br>TEPSEGSAPGTSESATPESGPGSEPATSGSETPGTSESATPESGPGSEPATSGSETPGTSE<br>SATPESGPGTSTEPSEGSAPGSPAGSPTSTEEGTSESATPESGPGSEPATSGSETPGTSES<br>ATPESGPGSPAGSPTSTEEGSPAGSPTSTEEGTSTEPSEGSAPGTSESATPESGPGTSESA<br>TPESGPGTSESATPESGPGSEPATSGSETPGSEPATSGSETPGSPAGSPTSTEEGTSTEPSE<br>GSAPGTSTEPSEGSAPGSEPATSGSETPGTSESATPESGPGTSTEPSEGSAPTAEAAGCG<br>TAEAAR | 237 |
| Seg 46 | ATGTATSEGSPEEEETAEAAGCGTAEAAGSPAGSPTSTEEGTSESATPESGPGTSTEPSE<br>GSAPGSPAGSPTSTEEGTSTEPSEGSAPGTSTEPSEGSAPGTSESATPESGPGSEPATSGS<br>ETPGSEPATSGSETPGSPAGSPTSTEEGTSESATPESGPGTSTEPSEGSAPGTSTEPSEGS<br>APGSPAGSPTSTEEGTSTEPSEGSAPGTSTEPSEGSAPGTSESATPESGPGTSTEPSEGSA<br>PGTSESATPESGPGSEPATSGSETPGTSTEPSEGSAPGTSTEPSEGSAPGTSESATPESGP<br>GTSESATPESGPTAEAAGCGTAEAAGSPAGSPTSTEEGTSESATPESGPGSEPATSGSET<br>PGTSESATPESGPGTSTEPSEGSAPGTSTEPSEGSAPGTSTEPSEGSAPGTSTEPSEGSAP<br>GTSTEPSEGSAPGTSTEPSEGSAPGSPAGSPTSTEEGTSTEPSEGSAPGTSESATPESGPG<br>SEPATSGSETPGTSESATPESGPGSEPATSGSETPGTSESATPESGPGTSTEPSEGSAPGT<br>SESATPESGPGSPAGSPTSTEEGSPAGSPTSTEEGSPAGSPTSTEEGTSESATPESGPGTS<br>TEPSEGSAPTAEAAGCGTAEAAGTSESATPESGPGSEPATSGSETPGTSESATPESGPGS<br>EPATSGSETPGTSESATPESGPGTSTEPSEGSAPGSPAGSPTSTEEGTSESATPESGPGSE<br>PATSGSETPGTSESATPESGPGSPAGSPTSTEEGSPAGSPTSTEEGTSTEPSEGSAPGTSE<br>SATPESGPGTSESATPESGPGTSESATPESGPGSEPATSGSETPGSEPATSGSETPGSPAG<br>SPTSTEEGTSTEPSEGSAPGTSTEPSEGSAPGSEPATSGSETPGTSESATPESGPGTSTEPS<br>EGSAPTAEAAGCGTAEAAR | 238 |
| Seg 47 | AEATTAAGGAEEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSESATPESGPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPTAEAAGCGTAEAAGTSESATPESGPGSEPATSGSETPGTSE<br>SATPESGPGSEPATSGSETPGTSESATPESGPGTSTEPSEGSAPGTSESATPESGPGSPAG<br>SPTSTEEGSPAGSPTSTEEGSPAGSPTSTEEGTSESATPESGPGTSTEPSEGSAPGTSESAT | 239 |

TABLE 3-continued

Cysteine- and lysine-engineered XTEN

| Name | Amino Acid Sequence | SEQ ID NO: |
|---|---|---|
| | PESGPGSEPATSGSETPGTSESATPESGPGSEPATSGSETPGTSESATPESGPGTSTEPSE<br>GSAPGSPAGSPTSTEEGTSESATPESGPGSEPATSGSETPGTSESATPESGPGSPAGSPTS<br>TEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSA<br>PGSEPATSGSETPGTSESATPESGPGTSTEPSEGSAPRPRPRPRP | |
| Seg 48 | AEATTAAGGAEEETAEAAGCGTAEAAGSPAGSPTSTEEGTSESATPESGPGTSTEPSEG<br>SAPGSPAGSPTSTEEGTSTEPSEGSAPGTSTEPSEGSAPGTSESATPESGPGSEPATSGSE<br>TPGSEPATSGSETPGSPAGSPTSTEEGTSESATPESGPGTSTEPSEGSAPGTSTEPSEGSA<br>PGSPAGSPTSTEEGTSTEPSEGSAPGTSTEPSEGSAPGTSESATPESGPGTSTEPSEGSAP<br>GTSESATPESGPGSEPATSGSETPGTSESATPESGPGSEPATSGSETPGTSESATPESGPG<br>TSESATPESGPGSPAGSPTSTEEGTSESATPESGPGSEPATSGSETPGTSESATPESGPGT<br>STEPSEGSAPGTSTEPSEGSAPGTSTEPSEGSAPGTSTEPSEGSAPGTS<br>TEPSEGSAPGSPAGSPTSTEEGTSTEPSEGSAPGTSESATPESGPGSEPATSGSETPGTSE<br>SATPESGPGSEPATSGSETPGTSESATPESGPGTSTEPSEGSAPGTSESATPESGPGSPAG<br>SPTSTEEGSPAGSPTSTEEGSPAGSPTSTEEGTSESATPESGPGTSTEPSEGSAPGTSESAT<br>PESGPGSEPATSGSETPGTSESATPESGPGSEPATSGSETPGTSESATPESGPGTSTEPSE<br>GSAPGSPAGSPTSTEEGTSESATPESGPGSEPATSGSETPGTSESATPESGPGSPAGSPTS<br>TEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSA<br>PGSEPATSGSETPGTSESATPESGPGTSTEPSEGSAPTAEAAGCGTAEAARPRPRPRP | 240 |
| Seg 49 | AEATTAAGGAEEETAEAAGCGTAEAAGSPAGSPTSTEEGTSESATPESGPGTSTEPSEG<br>SAPGSPAGSPTSTEEGTSTEPSEGSAPGTSTEPSEGSAPGTSESATPESGPGSEPATSGSE<br>TPGSEPATSGSETPGSPAGSPTSTEEGTSESATPESGPGTSTEPSEGSAPGTSTEPSEGSA<br>PGSPAGSPTSTEEGTSTEPSEGSAPGTSTEPSEGSAPGTSESATPESGPGTSTEPSEGSAP<br>GTSESATPESGPGSEPATSGSETPGTSESATPESGPGSEPATSGSETPGTSESATPESGPG<br>TSESATPESGPGSPAGSPTSTEEGTSESATPESGPGSEPATSGSETPGTSESATPESGPGT<br>STEPSEGSAPGTSTEPSEGSAPGTSTEPSEGSAPGTSTEPSEGSAPGTS<br>TEPSEGSAPGSPAGSPTSTEEGTSTEPSEGSAPTAEAAGCGTAEAAGTSESATPESGPGS<br>EPATSGSETPGTSESATPESGPGSEPATSGSETPGTSESATPESGPGTSTEPSEGSAPGTS<br>ESATPESGPGSPAGSPTSTEEGSPAGSPTSTEEGSPAGSPTSTEEGTSESATPESGPGTST<br>EPSEGSAPGTSESATPESGPGSEPATSGSETPGTSESATPESGPGSEPATSGSETPGTSES<br>ATPESGPGTSTEPSEGSAPGSPAGSPTSTEEGTSESATPESGPGSEPATSGSETPGTSESA<br>TPESGPGSPAGSPTSTEEGSPAGSPTSTEEGTSTEPSEGSAPGTSESATPESGPGTSESAT<br>PESGPGTSESATPESGPGSEPATSGSETPGSEPATSGSETPGSPAGSPTSTEEGTSTEPSE<br>GSAPGTSTEPSEGSAPGSEPATSGSETPGTSESATPESGPGTSTEPSEGSAPTAEAAGCG<br>TAEAARPRPRPRP | 241 |
| Seg 50 | AEATTAAGGAEEETAEAAGCGTAEAAGSPAGSPTSTEEGTSESATPESGPGTSTEPSEG<br>SAPGSPAGSPTSTEEGTSTEPSEGSAPGTSTEPSEGSAPGTSESATPESGPGSEPATSGSE<br>TPGSEPATSGSETPGSPAGSPTSTEEGTSESATPESGPGTSTEPSEGSAPGTSTEPSEGSA<br>PGSPAGSPTSTEEGTSTEPSEGSAPGTSTEPSEGSAPGTSESATPESGPGTSTEPSEGSAP<br>GTSESATPESGPGSEPATSGSETPGTSESATPESGPGSAPGTSTEPSEGSAPGTSESATPESGPG<br>TSESATPESGPTAEAAGCGTAEAAGSPAGSPTSTEEGTSESATPESGPGSEPATSGSETP<br>GTSESATPESGPGTSTEPSEGSAPGTSTEPSEGSAPGTSTEPSEGSAPG<br>TSTEPSEGSAPGTSTEPSEGSAPGSPAGSPTSTEEGTSTEPSEGSAPGTSESATPESGPGS<br>EPATSGSETPGTSESATPESGPGSEPATSGSETPGTSESATPESGPGTSTEPSEGSAPGTS<br>ESATPESGPGSPAGSPTSTEEGSPAGSPTSTEEGSPAGSPTSTEEGTSESATPESGPGTST<br>EPSEGSAPTAEAAGCGTAEAAGTSESATPESGPGSEPATSGSETPGTSESATPESGPGSE<br>PATSGSETPGTSESATPESGPGTSTEPSEGSAPGSPAGSPTSTEEGTSESATPESGPGSEP<br>ATSGSETPGTSESATPESGPGSPAGSPTSTEEGSPAGSPTSTEEGTSTEPSEGSAPGTSES<br>ATPESGPGTSESATPESGPGTSESATPESGPGSEPATSGSETPGSEPATSGSETPGSPAGS<br>PTSTEEGTSTEPSEGSAPGTSTEPSEGSAPGSEPATSGSETPGTSESATPESGPGTSTEPSE<br>GSAPTAEAAGCGTAEAARPRPRPRP | 242 |
| Seg 51 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSESATPESGPGSAPGTSTEPSEGSAPGTSTEPSEGSAPGSPAG<br>SPTSTEEGTSTEPSEGSAPTAEAAGCGTAEAAGTSESATPESGPGSEPATSGSETPGTSE<br>SATPESGPGSEPATSGSETPGTSESATPESGPGTSTEPSEGSAPGTSESATPESGPGSPAG<br>SPTSTEEGSPAGSPTSTEEGSPAGSPTSTEEGTSESATPESGPGTSTEPSEGSAPGTSESAT<br>PESGPGSEPATSGSETPGTSESATPESGPGSEPATSGSETPGTSESATPESGPGTSTEPSE<br>GSAPGSPAGSPTSTEEGTSESATPESGPGSEPATSGSETPGTSESATPESGPGSPAGSPTS<br>TEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSA<br>PGSEPATSGSETPGTSESATPESGPGTSTEPSEGSAPR | 243 |
| Seg 52 | AEATTAAGGAEEETAEAAGCGTAEAAGSPAGSPTSTEEGTSESATPESGPGTSTEPSEG<br>SAPGSPAGSPTSTEEGTSTEPSEGSAPGTSTEPSEGSAPGTSESATPESGPGSEPATSGSE<br>TPGSEPATSGSETPGSPAGSPTSTEEGTSESATPESGPGTSTEPSEGSAPGTSTEPSEGSA<br>PGSPAGSPTSTEEGTSTEPSEGSAPGTSTEPSEGSAPGTSESATPESGPGTSTEPSEGSAP | 244 |

TABLE 3-continued

Cysteine- and lysine-engineered XTEN

| Name | Amino Acid Sequence | SEQ ID NO: |
| --- | --- | --- |
| | GTSESATPESGPGSEPATSGSETPGTSTEPSEGSAPGTSTEPSEGSAPGTSESATPESGPG
TSESATPESGPGSPAGSPTSTEEGTSESATPESGPGSEPATSGSETPGTSESATPESGPGT
STEPSEGSAPGTSTEPSEGSAPGTSTEPSEGSAPGTSTEPSEGSAPGTSTEPSEGSAPGTS
TEPSEGSAPGSPAGSPTSTEEGTSTEPSEGSAPGTSESATPESGPGSEPATSGSETPGTSE
SATPESGPGSEPATSGSETPGTSESATPESGPGTSTEPSEGSAPGTSESATPESGPGSPAG
SPTSTEEGSPAGSPTSTEEGSPAGSPTSTEEGTSESATPESGPGTSTEPSEGSAPGTSESAT
PESGPGSEPATSGSETPGTSESATPESGPGSEPATSGSETPGTSESATPESGPGTSTEPSE
GSAPGSPAGSPTSTEEGTSESATPESGPGSEPATSGSETPGTSESATPESGPGSPAGSPTS
TEEGSPAGSPTSTEEGSTEPSEGSAPGTSESATPESGPGTSESATPESGPGTSESATPES
GPGSEPATSGSETPGSEPATSGSETPGSPAGSPTSTEEGTSTEPSEGSAPGTSTEPSEGSA
PGSEPATSGSETPGTSESATPESGPGTSTEPSEGSAPTAEAAGCGTAEAAR | |
| Seg 53 | AEATTAAGGAEEETAEAAGCGTAEAAGSPAGSPTSTEEGTSESATPESGPGTSTEPSEG
SAPGSPAGSPTSTEEGTSTEPSEGSAPGTSTEPSEGSAPGTSESATPESGPGSEPATSGSE
TPGSEPATSGSETPGSPAGSPTSTEEGTSESATPESGPGTSTEPSEGSAPGTSTEPSEGSA
PGSPAGSPTSTEEGTSTEPSEGSAPGTSTEPSEGSAPGTSESATPESGPGTSTEPSEGSAP
GTSESATPESGPGSEPATSGSETPGTSTEPSEGSAPGTSTEPSEGSAPGTSESATPESGPG
TSESATPESGPGSPAGSPTSTEEGTSESATPESGPGSEPATSGSETPGTSESATPESGPGT
STEPSEGSAPGTSTEPSEGSAPGTSTEPSEGSAPGTSTEPSEGSAPGTSTEPSEGSAPGTS
TEPSEGSAPGSPAGSPTSTEEGTSTEPSEGSAPTAEAAGCGTAEAAGTSESATPESGPGS
EPATSGSETPGTSESATPESGPGSEPATSGSETPGTSESATPESGPGTSTEPSEGSAPGTS
ESATPESGPGSPAGSPTSTEEGSPAGSPTSTEEGSPAGSPTSTEEGTSESATPESGPGTST
EPSEGSAPGTSESATPESGPGSEPATSGSETPGTSESATPESGPGSEPATSGSETPGTSES
ATPESGPGTSTEPSEGSAPGSPAGSPTSTEEGTSESATPESGPGSEPATSGSETPGTSESA
TPESGPGSPAGSPTSTEEGSPAGSPTSTEEGSTEPSEGSAPGTSESATPESGPGTSESAT
PESGPGTSESATPESGPGSEPATSGSETPGSEPATSGSETPGSPAGSPTSTEEGTSTEPSE
GSAPGTSTEPSEGSAPGSEPATSGSETPGTSESATPESGPGTSTEPSEGSAPTAEAAGCG
TAEAAR | 245 |
| Seg 54 | AEATTAAGGAEEETAEAAGCGTAEAAGSPAGSPTSTEEGTSESATPESGPGTSTEPSEG
SAPGSPAGSPTSTEEGTSTEPSEGSAPGTSTEPSEGSAPGTSESATPESGPGSEPATSGSE
TPGSEPATSGSETPGSPAGSPTSTEEGTSESATPESGPGTSTEPSEGSAPGTSTEPSEGSA
PGSPAGSPTSTEEGTSTEPSEGSAPGTSTEPSEGSAPGTSESATPESGPGTSTEPSEGSAP
GTSESATPESGPGSEPATSGSETPGTSTEPSEGSAPGTSTEPSEGSAPGTSESATPESGPG
TSESATPESGPTAEAAGCGTAEAAGSPAGSPTSTEEGTSESATPESGPGSEPATSGSETP
GTSESATPESGPGTSTEPSEGSAPGTSTEPSEGSAPGTSTEPSEGSAPGTSTEPSEGSAPG
TSTEPSEGSAPGTSTEPSEGSAPGSPAGSPTSTEEGTSTEPSEGSAPGTSESATPESGPGS
EPATSGSETPGTSESATPESGPGSEPATSGSETPGTSESATPESGPGTSTEPSEGSAPGTS
ESATPESGPGSPAGSPTSTEEGSPAGSPTSTEEGSPAGSPTSTEEGTSESATPESGPGTST
EPSEGSAPTAEAAGCGTAEAAGTSESATPESGPGSEPATSGSETPGTSESATPESGPGSE
PATSGSETPGTSESATPESGPGTSTEPSEGSAPGSPAGSPTSTEEGTSESATPESGPGSEP
ATSGSETPGTSESATPESGPGSPAGSPTSTEEGSPAGSPTSTEEGSTEPSEGSAPGTSES
ATPESGPGTSESATPESGPGTSESATPESGPGSEPATSGSETPGSEPATSGSETPGSPAGS
PTSTEEGTSTEPSEGSAPGTSTEPSEGSAPGSEPATSGSETPGTSESATPESGPGTSTEPSE
GSAPTAEAAGCGTAEAAR | 246 |
| Seg 55 | AEATTAAGGAEEETAEAAGCGTAEAAGSPAGSPTSTEEGTSESATPESGPGTSTEPSEG
SAPGSPAGSPTSTEEGTSTEPSEGSAPGTSTEPSEGSAPGTSESATPESGPGSEPATSGSE
TPGSEPATSGSETPGSPAGSPTSTEEGTSESATPESGPGTSTEPSEGSAPGTSTEPSEGSA
PGSPAGSPTSTEEGTSTEPSEGSAPGTSTEPSEGSAPGTSESATPESGPGTSTEPSEGSAP
GTSESATPESGPGSEPATSGSETPGTSTEPSEGSAPGTSTEPSEGSAPGTSESATPESGPG
TSESATPESGPGGKPGGSPAGSPTSTEEGSPAGSPTSTEEGSPAGSPTSTEEGSPAGSPTSESATPE
SGPGTSTEPSEGSAPGTSTEPSEGSAPGTSTEPSEGSAPGTSTEPSEGSAPGTSTEPSEGS
APGTSTEPSEGSAPGSPAGSPTSTEEGTSTEPSEGSAPGTSESATPESGPGSEPATSGSET
PGTSESATPESGPGSEPATSGSETPGTSESATPESGPGTSTEPSEGSAPGTSESATPESGP
GSPAGSPTSTEEGSPAGSPTSTEEGSPAGSPTSTEEGTSESATPESGPGTSTEPSEGSAPT
AEAAGCGTAEAAGTSESATPESGPGSEPATSGSETPGTSESATPESGPGSEPATSGSETP
GTSESATPESGPGTSTEPSEGSAPGSPAGSPTSTEEGTSESATPESGPGSEPATSGSETPG
TSESATPESGPGSPAGSPTSTEEGSPAGSPTSTEEGSTEPSEGSAPGTSESATPESGPGT
SESATPESGPGTSESATPESGPGSEPATSGSETPGSEPATSGSETPGSPAGSPTSTEEGTS
TEPSEGSAPGTSTEPSEGSAPGSEPATSGSETPGTSESATPESGPGTSTEPSEGSAPGGKP
GR | 247 |
| Seg 56 | AEATTAAGGAEEETAEAAGCGTAEAAGSPAGSPTSTEEGTSESATPESGPGTSTEPSEG
SAPGSPAGSPTSTEEGTSTEPSEGSAPGTSTEPSEGSAPGTSESATPESGPGSEPATSGSE
TPGSEPATSGSETPGSPAGSPTSTEEGTSESATPESGPGTSTEPSEGSAPGTSTEPSEGSA
PGSPAGSPTSTEEGTSTEPSEGSAPGTSTEPSEGSAPGTSESATPESGPGTSTEPSEGSAP
GTSESATPESGPGSEPATSGSETPGTSTEPSEGSAPGTSTEPSEGSAPGTSESATPESGPG
TSESATPESGPTAEAAGCGTAEAAGSPAGSPTSTEEGTSESATPESGPGSEPATSGSETP
GTSESATPESGPGTSTEPSEGSAPGTSTEPSEGSAPGTSTEPSEGSAPGTSTEPSEGSAPG
TSTEPSEGSAPGTSTEPSEGSAPGSPAGSPTSTEEGTSTEPSEGSAPGTSESATPESGPGS
EPATSGSETPGTSESATPESGPGSEPATSGSETPGTSESATPESGPGTSTEPSEGSAPGTS
ESATPESGPGSPAGSPTSTEEGSPAGSPTSTEEGSPAGSPTSTEEGTSESATPESGPGTST
EPSEGSAPTAEAAGCGTAEAAGTSESATPESGPGSEPATSGSETPGTSESATPESGPGSE
PATSGSETPGTSESATPESGPGTSTEPSEGSAPGSPAGSPTSTEEGTSESATPESGPGSEP
ATSGSETPGTSESATPESGPGSPAGSPTSTEEGSPAGSPTSTEEGSTEPSEGSAPGTSES | 248 |

TABLE 3-continued

Cysteine- and lysine-engineered XTEN

| Name | Amino Acid Sequence | SEQ ID NO: |
|---|---|---|
| | ATPESGPGTSESATPESGPGTSESATPESGPGSEPATSGSETPGSEPATSGSETPGSPAGS<br>PTSTEEGTSTEPSEGSAPGTSTEPSEGSAPGSEPATSGSETPGTSESATPESGPGTSTEPSE<br>GSAPGGKPGR | |
| Seg 57 | AEATTAAGGAEEEEGGKPGGSPAGSPTSTEEGTSESATPESGPGTSTEPSEGSAPGSPAG<br>SPTSTEEGTSTEPSEGSAPGTSTEPSEGSAPGTSESATPESGPGSEPATSGSETPGSEPATS<br>GSETPGSPAGSPTSTEEGTSESATPESGPGTSTEPSEGSAPGTSTEPSEGSAPGSPAGSPT<br>STEEGTSTEPSEGSAPGTSTEPSEGSAPGTSESATPESGPGTSTEPSEGSAPGTSESATPES<br>GPGSEPATSGSETPGTSTEPSEGSAPGTSTEPSEGSAPGTSESATPESGPGTSESATPESG<br>PGGKPGGSPAGSPTSTEEGTSESATPESGPGSEPATSGSETPGSESATPESGPGTSTEPS<br>EGSAPGTSTEPSEGSAPGTSTEPSEGSAPGTSTEPSEGSAPGTSTEPSEGSAPGTSTEPSE<br>GSAPGSPAGSPTSTEEGTSTEPSEGSAPGTSESATPESGPGSEPATSGSETPGTSESATPE<br>SGPGSEPATSGSETPGTSESATPESGPGTSTEPSEGSAPGTSESATPESGPGSPAGSPTST<br>EEGSPAGSPTSTEEGSPAGSPTSTEEGTSESATPESGPGTSTEPSEGSAPGGKPGGTSESA<br>TPESGPGSEPATSGSETPGTSESATPESGPGSEPATSGSETPGTSESATPESGPGTSTEPSE<br>GSAPGSPAGSPTSTEEGTSESATPESGPGSEPATSGSETPGTSESATPESGPGSPAGSPTS<br>TEEGSPAGSPTSTEEGSTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSA<br>PGSEPATSGSETPGTSESATPESGPGTSTEPSEGSAPTAEAAGCGTAEAAR | 249 |
| Seg 58 | AEATTAAGGAEEETAEAAGCGTAEAAGSPAGSPTSTEEGTSESATPESGPGTSTEPSEG<br>SAPGSPAGSPTSTEEGTSTEPSEGSAPGTSTEPSEGSAPGTSESATPESGPGSEPATSGSE<br>TPGSEPATSGSETPGSPAGSPTSTEEGTSESATPESGPGTSTEPSEGSAPGTSTEPSEGSA<br>PGSPAGSPTSTEEGTSTEPSEGSAPGTSTEPSEGSAPGTSESATPESGPGTSTEPSEGSAP<br>GTSESATPESGPGSEPATSGSETPGTSTEPSEGSAPGTSTEPSEGSAPGTSESATPESGPG<br>TSESATPESGPGGKPGGSPAGSPTSTEEGTSESATPESGPGSEPATSGSETPGTSESATPE<br>SGPGTSTEPSEGSAPGTSTEPSEGSAPGTSTEPSEGSAPGTSTEPSEGSAPGTSTEPSEGS<br>APGTSTEPSEGSAPGSPAGSPTSTEEGTSTEPSEGSAPGTSESATPESGPGSEPATSGSET<br>PGTSESATPESGPGSEPATSGSETPGTSESATPESGPGTSTEPSEGSAPGTSESATPESGP<br>GSPAGSPTSTEEGSPAGSPTSTEEGSPAGSPTSTEEGTSESATPESGPGTSTEPSEGSAPT<br>AEAAGCGTAEAAGTSESATPESGPGSEPATSGSETPGTSESATPESGPGSEPATSGSETP<br>GTSESATPESGPGTSTEPSEGSAPGSPAGSPTSTEEGTSESATPESGPGSEPATSGSETPG<br>TSESATPESGPGSPAGSPTSTEEGSPAGSPTSTEEGTSTEPSEGSAPGTSESATPESGPGT<br>SESATPESGPGTSESATPESGPGSEPATSGSETPGSEPATSGSETPGSPAGSPTSTEEGTS<br>TEPSEGSAPGTSTEPSEGSAPGSEPATSGSETPGTSESATPESGPGTSTEPSEGSAPGGKP<br>GR | 250 |
| Seg 59 | AEATTAAGGAEEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPGTSESATPESGPGSEPATSGSETPGTSESATPESGPGSEPATS<br>GSETPGTSESATPESGPGTSTEPSEGSAPGTSESATPESGPGSPAGSPTSTEEGSPAGSPT<br>STEEGSPAGSPTSTEEGTSESATPESGPGTSTEPSEGSAPTAEAAGCGTAEAAR | 251 |
| Seg 60 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPTAEAAGCGTAEAAR | 252 |
| Seg 61 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGPTAE<br>AAGCGTAEAAR | 253 |
| Seg 62 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPTAEAAGCGTAEAAR | 254 |
| Seg 63 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPGTSESATPESGPGSEPATSGSETPGTSESATPESGPGSEPATS | 255 |

TABLE 3-continued

Cysteine- and lysine-engineered XTEN

| Name | Amino Acid Sequence | SEQ ID NO: |
|---|---|---|
| | GSETPGTSESATPESGPGTSTEPSEGSAPGTSESATPESGPGSPAGSPTSTEEGSPAGSPT<br>STEEGSPAGSPTSTEEGTSESATPESGPGTSTEPSEGSAPTAEAAGCGTAEAAR | |
| Seg 64 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPTAEAAGCGTAEAAR | 256 |
| Seg 65 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGPTAE<br>AAGCGTAEAAR | 257 |
| Seg 66 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPTAEAAGCGTAEAAR | 258 |
| Seg 67 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPGTSESATPESGPGSEPATSGSETPGTSESATPESGPGSEPATS<br>GSETPGTSESATPESGPGTSTEPSEGSAPGTSESATPESGPGSPAGSPTSTEEGSPAGSPT<br>STEEGSPAGSPTSTEEGTSESATPESGPGTSTEPSEGSAPGGKPGR | 259 |
| Seg 68 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPGGKPGR | 260 |
| Seg 69 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGPGGK<br>PGR | 261 |
| Seg 70 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGGKPGR | 262 |
| Seg 71 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPGTSESATPESGPGSEPATSGSETPGTSESATPESGPGSEPATS<br>GSETPGTSESATPESGPGTSTEPSEGSAPGTSESATPESGPGSPAGSPTSTEEGSPAGSPT<br>STEEGSPAGSPTSTEEGTSESATPESGPGTSTEPSEGSAPGGKPGR | 263 |
| Seg 72 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP<br>GSPAGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAG<br>SPTSTEEGTSTEPSEGSAPGGKPGR | 264 |
| Seg 73 | AEATTAAGGAEEEGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETP | 265 |

TABLE 3-continued

Cysteine- and lysine-engineered XTEN

| Name | Amino Acid Sequence | SEQ ID NO: |
|---|---|---|
| | GSPAGSPTSTEEGTSESATPESGPGTSTEPSEGSAPGTSTEPSEGSAPGSPAGSPTSTEEG TSTEPSEGSAPGTSTEPSEGSAPGTSESATPESGPGTSTEPSEGSAPGTSESATPESGPGS EPATSGSETPGTSTEPSEGSAPGTSTEPSEGSAPGTSESATPESGPGTSESATPESGPGGK PGR | |
| Seg 74 | AEATTAAGGAEEEGSPAGSPTSTEEGTSESATPESGPGTSTEPSEGSAPGSPAGSPTSTE EGTSTEPSEGSAPGTSTEPSEGSAPGTSESATPESGPGSEPATSGSETPGSEPATSGSETP GSPAGSPTSTEEGTSESATPESGPGTSTEPSEGSAPGGKPGR | 266 |
| Seg 75 | AGASPGTSSTGSPGSSPSASTGTGPGSSPSASTGTGPGTPGSGTASSSPGSSTPSGATGSP GSSPSASTGTGPGASPGTSSTGSPGTPGSGTASSSPGSSTPSGATGSPGTPGSGTASSSPG ASPGTSSTGSPGASPGTSSTGSPGTPGSGTASSSPGSSTPSGATGSPGASPGTSSTGSPGT PGSGTASSSPGSSTPSGATGSPGSSPSASTGTGPGSSPSASTGTGPGSSTPSGATGSPGSS TPSGATGSPGASPGTSSTGSPGASPGTSSTGSPGASPGTSSTGSPGTPGSGTASSSPGASP GTSSTGSPGASPGTSSTGSPGASPGTSSTGSPGSSPSASTGTGPGTPGSGTASSSPGASPG TSSTGSPGASPGTSSTGSPGASPGTSSTGSPGSSTPSGATGSPGSSTPSGATGSPGASPGT SSTGSPTAEAAGCGTAEAAGTPGSGTASSSPGSSTPSGATGSPGSSTPSGATGSPGSSTP SGATGSPGSSPSASTGTGPGASPGTSSTGSPGASPGTSSTGSPGTPGSGTASSSPGASPG TSSTGSPGASPGTSSTGSPGASPGTSSTGSPGASPGTSSTGSPGTPGSGTASSSPGSSTPS GATGSPGTPGSGTASSSPGSSTPSGATGSPGTPGSGTASSSPGSSTPSGATGSPGSSTPSG ATGPGSSPSASTGTGPGSSPSASTGTGPGASPGTSSTGSPGTPGSGTASSSPGSSTPSGA TGSPGSSPSASTGTGPGSSPSASTGTGPGASPGTSSTGSPGASPGTSSTGSPGSSTPSGAT GSPGSSPSASTGTGPGASPGTSSTGSPGSSPSASTGTGPGTPGSGTASSSPGSSTPSGATG SPGSSTPSGATGSPGASPGTSSTGSPR | 267 |
| Seg 76 | ATAEAAGCGTAEAAGASPGTSSTGSPGSSPSASTGTGPGSSPSASTGTGPGTPGSGTAS SSPGSSTPSGATGSPGSSPSASTGTGPGASPGTSSTGSPGTPGSGTASSSPGSSTPSGATG SPGTPGSGTASSSPGASPGTSSTGSPGASPGTSSTGSPGTPGSGTASSSPGSSTPSGATGS PGASPGTSSTGSPGTPGSGTASSSPGSSTPSGATGSPGSSPSASTGTGPGSSPSASTGTGP GSSTPSGATGSPGSSTPSGATGSPGASPGTSSTGSPGASPGTSSTGSPGASPGTSSTGSPG TPGSGTASSSPGASPGTSSTGSPGASPGTSSTGSPGASPGTSSTGSPGSSPSASTGTGPGT PGSGTASSSPGASPGTSSTGSPGASPGTSSTGSPGASPGTSSTGSPGSSTPSGATGSPGSS TPSGATGSPGASPGTSSTGSPGTPGSGTASSSPGSSTPSGATGSPGSSTPSGATGSPGSST PSGATGSPGSSPSASTGTGPGASPGTSSTGSPGASPGTSSTGSPGTPGSGTASSSPGASPG TSSTGSPGASPGTSSTGSPGASPGTSSTGSPGTPGSGTASSSPGSSTPS GATGSPGTPGSGTASSSPGSSTPSGATGSPGTPGSGTASSSPGSSTPSGATGSPGSSTPSG ATGSPGSSPSASTGTGPGSSPSASTGTGPGASPGTSSTGSPGTPGSGTASSSPGSSTPSGA TGSPGSSPSASTGTGPGSSPSASTGTGPGASPGTSSTGSPGASPGTSSTGSPGSSTPSGAT GSPGSSPSASTGTGPGASPGTSSTGSPGSSPSASTGTGPGTPGSGTASSSPGSSTPSGATG SPGSSTPSGATGSPGASPGTSSTGSPTAEAAGCGTAEAAR | 268 |
| Seg 77 | ATAEAAGCGTAEAAGASPGTSSTGSPGSSPSASTGTGPGSSPSASTGTGPGTPGSGTAS SSPGSSTPSGATGSPGSSPSASTGTGPGASPGTSSTGSPGTPGSGTASSSPGSSTPSGATG SPGTPGSGTASSSPGASPGTSSTGSPGASPGTSSTGSPGTPGSGTASSSPGSSTPSGATGS PGASPGTSSTGSPGTPGSGTASSSPGSSTPSGATGSPGSSPSASTGTGPGSSPSASTGTGP GSSTPSGATGSPGSSTPSGATGSPGASPGTSSTGSPGASPGTSSTGSPGASPGTSSTGSPG TPGSGTASSSPGASPGTSSTGSPGASPGTSSTGSPGASPGTSSTGSPGSSTPSGATGSPGSS TPSGATGSPGASPGTSSTGSPTAEAAGCGTAEAAGTPGSGTASSSPGSSTPSGATGSPG SSTPSGATGSPGSSTPSGATGSPGSSPSASTGTGPGASPGTSSTGSPGASPGTSSTGSPGT PGSGTASSSPGASPGTSSTGSPGASPGTSSTGSPGASPGTSSTGSPGASPGTSSTGSPGTP GSGTASSSPGSSTPSGATGSPGTPGSGTASSSPGSSTPSGATGSPGTPGSGTASSSPGSST PSGATGSPGSSTPSGATGSPGSSPSASTGTGPGSSPSASTGTGPGASPGTSSTGSPGTPGS GTASSSPGSSTPSGATGSPGSSPSASTGTGPGSSPSASTGTGPGASPGTSSTGSPGASPGT SSTGSPGSSTPSGATGSPGSSPSASTGTGPGASPGTSSTGSPGSSPSASTGTGPGTPGSGT ASSSPGSSTPSGATGSPGSSTPSGATGSPGASPGTSSTGSPTAEAAGCGTAEAAR | 269 |
| Seg 78 | ATAEAAGCGTAEAAGASPGTSSTGSPGSSPSASTGTGPGSSPSASTGTGPGTPGSGTAS SSPGSSTPSGATGSPGSSPSASTGTGPGASPGTSSTGSPGTPGSGTASSSPGSSTPSGATG SPGTPGSGTASSSPGASPGTSSTGSPGASPGTSSTGSPGTPGSGTASSSPGSSTPSGATGS PGASPGTSSTGSPGTPGSGTASSSPGSSTPSGATGSPGSSPSASTGTGPGSSPSASTGTGP GSSTPSGATGSPGSSTPSGATGSPGASPGTSSTGSPGASPGTSSTGSPGASPGTSSTGSPT AEAAGCGTAEAAGTPGSGTASSSPGASPGTSSTGSPGASPGTSSTGSPGASPGTSSTGSP GSSPSASTGTGPGTPGSGTASSSPGASPGTSSTGSPGASPGTSSTGSPGASPGTSSTGSPG SSTPSGATGSPGSSTPSGATGSPGASPGTSSTGSPGTPGSGTASSSPGSSTPSGATGSPGS STPSGATGSPGSSTPSGATGSPGSSPSASTGTGPGASPGTSSTGSPGASPGTSSTGSPGTP GSGTASSSPGASPGTSSTGSPGASPGTSSTGSPGASPGTSSTGSPTAEA AGCGTAEAAGTPGSGTASSSPGSSTPSGATGSPGTPGSGTASSSPGSSTPSGATGSPGTP GSGTASSSPGSSTPSGATGSPGSSTPSGATGSPGSSPSASTGTGPGSSPSASTGTGPGASP GTSSTGSPGTPGSGTASSSPGSSTPSGATGSPGSSPSASTGTGPGSSPSASTGTGPGASPG TSSTGSPGASPGTSSTGSPGSSTPSGATGSPGSSPSASTGTGPGASPGTSSTGSPGSSPSA STGTGPGTPGSGTASSSPGSSTPSGATGSPGSSTPSGATGSPGASPGTSSTGSPTAEAAG CGTAEAAR | 270 |
| Seg 79 | ATAEAAGCGTAEAAGASPGTSSTGSPGSSPSASTGTGPGSSPSASTGTGPGTPGSGTAS SSPGSSTPSGATGSPGSSPSASTGTGPGASPGTSSTGSPGTPGSGTASSSPGSSTPSGATG | 271 |

TABLE 3-continued

Cysteine- and lysine-engineered XTEN

| Name | Amino Acid Sequence | SEQ ID NO: |
|---|---|---|
| | SPGTPGSGTASSSPGASPGTSSTGSPGASPGTSSTGSPGTPGSGTASSSPGSSTPSGATGS<br>PGASPGTSSTGSPGTPGSGTASSSPGSSTPSGATGSPGSSPSASTGTGPTAEAAGCGTAE<br>AAGSSPSASTGTGPGSSTPSGATGSPGSSTPSGATGSPGASPGTSSTGSPGASPGTSSTG<br>SPGASPGTSSTGSPGTPGSGTASSSPGASPGTSSTGSPGASPGTSSTGSPGASPGTSSTG<br>PGSSPSASTGTGPGTPGSGTASSSPGASPGTSSTGSPGASPGTSSTGSPGASPGTSSTGSP<br>GSSTPSGATGSPGSSTPSGATGSPGASPGTSSTGSPTAEAAGCGTAEAAGTPGSGTASS<br>SPGSSTPSGATGSPGSSTPSGATGSPGSSTPSGATGSPGSSPSASTGTGPGASPGTSSTGS<br>PGASPGTSSTGSPGTPGSGTASSSPGASPGTSSTGSPGASPGTSSTGSPGASPGTSSTGSP<br>GASPGTSSTGSPGTPGSGTASSSPGSSTPSGATGSPGTPGSGTASSSPGSSTPSGATGSPG<br>TPGSGTASSSPGSSTPSGATGSPTAEAAGCGTAEAAGSSTPSGATGSPGSSPSASTGTGP<br>GSSPSASTGTGPGASPGTSSTGSPGTPGSGTASSSPGSSTPSGATGSPGSSPSASTGTGPG<br>SSPSASTGTGPGASPGTSSTGSPGASPGTSSTGSPGSSTPSGATGSPGSSPSASTGTGPGA<br>SPGTSSTGSPGSSPSASTGTGPGTPGSGTASSSPGSSTPSGATGSPGSSTPSGATGSPGAS<br>PGTSSTGSPTAEAAGCGTAEAAR | |
| Seg 80 | ATAEAAGCGTAEAAGASPGTSSTGSPGSSPSASTGTGPGSSPSASTGTGPGTPGSGTAS<br>SSPGSSTPSGATGSPGSSPSASTGTGPGASPGTSSTGSPGTPGSGTASSSPGSSTPSGATG<br>SPGTPGSGTASSSPGASPGTSSTGSPGASPGTSSTGSPGTPGSGTASSSPGSSTPSGATGS<br>PGASPGTAEAAGCGTAEAATSSTGSPGTPGSGTASSSPGSSTPSGATGSPGSSPSASTGT<br>GPGSSPSASTGTGPGSSTPSGATGSPGSSTPSGATGSPGASPGTSSTGSPGASPGTSSTGS<br>PGASPGTSSTGSPGTPGSGTASSSPGASPGTSSTGSPGASPGTSSTGSPGASPGTSSTGSP<br>GSSPSASTGTTAEAAGCGTAEAAGPGTPGSGTASSSPGASPGTSSTGSPGASPGTSSTG<br>SPGASPGTSSTGSPGSSTPSGATGSPGSSTPSGATGSPGASPGTSSTGSPGTPGSGTASSS<br>PGSSTPSGATGSPGSSTPSGATGSPGSSTPSGATGSPGSSPSASTGTGPGASPGTSSTGSP<br>GASPGTSSTGSPGTTAEAAGCGTAEAAPGSGTASSSPGASPGTSSTGSPGASPGTSSTG<br>SPGASPGTSSTGSPGASPGTSSTGSPGTPGSGTASSSPGSSTPSGATGSPGTPGSGTASSS<br>PGSSTPSGATGSPGTPGSGTASSSPGSSTPSGATGSPGSSTPSGATGSPGSSPSASTGTGP<br>GSSPSASTGTGPGASPGTSTAEAAGCGTAEAASTGSPGTPGSGTASSSPGSSTPSGATG<br>SPGSSPSASTGTGPGSSPSASTGTGPGASPGTSSTGSPGASPGTSSTGSPGSSTPSGATGS<br>PGSSPSASTGTGPGASPGTSSTGSPGSSPSASTGTGPGTPGSGTASSSPGSSTPSGATGSP<br>GSSTPSGATGSPGASPGTSSTGSPTAEAAGCGTAEAAR | 272 |
| Seg 81 | ATAEAAGCGTAEAAGASPGTSSTGSPGSSPSASTGTGPGSSPSASTGTGPGTPGSGTAS<br>SSPGSSTPSGATGSPGSSPSASTGTGPGASPGTSSTGSPGTPGSGTASSSPGSSTPSGATG<br>SPGTPGSGTASSSPGASPGTSSTGSPGASPGTSSTGSPTAEAAGCGTAEAAGTPGSGTA<br>SSSPGSSTPSGATGSPGASPGTSSTGSPGTPGSGTASSSPGSSTPSGATGSPGSSPSASTG<br>TGPGSSPSASTGTGPGSSTPSGATGSPGSSTPSGATGSPGASPGTSSTGSPGASPGTSSTG<br>SPGASPGTSSTGSPTAEAAGCGTAEAAGTPGSGTASSSPGSSTPSGATGSPGASPGTSST<br>GSPGASPGTSSTGSPGSSPSASTGTGPGTPGSGTASSSPGASPGTSSTGSPGASPGTSSTG<br>SPGASPGTSSTGSPGSSTPSGATGSPGSSTPSGATGSPGASPGTSSTGSPTAEAAGCGTA<br>EAAGTPGSGTASSSPGSSTPSGATGSPGSSTPSGATGSPGSSTPSGATGSPGSSPSASTGT<br>GPGASPGTSSTGSPGASPGTSSTGSPGTPGSGTASSSPGSSTPSGATGSPGASPGTSSTGS<br>PGASPGTSSTGSPGASPGTSSTGSPTAEAAGCGTAEAAGTPGSGTASSSPGSSTPSGAT<br>GSPGTPGSGTASSSPGSSTPSGATGSPGTPGSGTASSSPGSSTPSGATGSPGSSTPSGATG<br>SPGSSPSASTGTGPGSSPSASTGTGPGASPGTSSTGSPGTPGSGTASSSPGSSTPSGATGS<br>PTAEAAGCGTAEAAGSSPSASTGTGPGSSPSASTGTGPGASPGTSSTGSPGASPGTSST<br>GSPGSSTPSGATGSPGSSPSASTGTGPGASPGTSSTGSPGSSPSASTGTGPGTPGSGTASS<br>SPGSSTPSGATGSPGSSTPSGATGSPGASPGTSSTGSPTAEAAGCGTAEAAR | 273 |
| Seg 82 | ATAEAAGCGTAEAAGASPGTSSTGSPGSSPSASTGTGPGSSPSASTGTGPGTPGSGTAS<br>SSPGSSTPSGATGSPGSSPSASTGTGPGASPGTSSTGSPGTPGSGTASSSPGSSTPSGATG<br>SPGTPGSGTASSSPGASTAEAAGCGTAEAAPGTSSTGSPGASPGTSSTGSPGTPGSGTA<br>SSSPGSSTPSGATGSPGASPGTSSTGSPGTPGSGTASSSPGSSTPSGATGSPGSSPSASTG<br>TGPGSSPSASTGTGPGSSTPSGATGSPGSSTPSGTAEAAGCGTAEAAATGSPGASPGTS<br>STGSPGASPGTSSTGSPGASPGTSSTGSPGTPGSGTASSSPGASPGTSSTGSPGASPGTSS<br>TGSPGASPGTSSTGSPGSSPSASTGTGPGTPGSGTASSSPGASPGTSSTGTAEAAGCGTA<br>EAASPGASPGTSSTGSPGASPGTSSTGSPGSSTPSGATGSPGSSTPSGATGSPGASPGTSS<br>TGSPGTPGSGTASSSPGSSTPSGATGSPGSSTPSGATGSPGSSTPSGATGSPGSSPSASTG<br>TGPGATAEAAGCGTAEAASPGTSSTGSPGASPGTSSTGSPGASPGTSSTGSPGASPGTS<br>STGSPGASPGTSSTGSPGASPGTSSTGSPGASPGTSSTGSPGTPGSGTASSSPGSSTPSGA<br>TGSPGTPGSGTASSSPGSSTPTAEAAGCGTAEAASGATGSPGTPGSGTASSSPGSSTPSG<br>ATGSPGSSTPSGATGSPGSSPSASTGTGPGSSPSASTGTGPGASPGTSSTGSPGTPGSGT<br>ASSSPGSSTPSGATGSPGSSPSASTGTGPGSSPSASTGTAEAAGCGTAEAATGPGASPGT<br>SSTGSPGASPGTSSTGSPGSSTPSGATGSPGSSPSASTGTGPGASPGTSSTGSPGSSPSAS<br>TGTGPGTPGSGTASSSPGSSTPSGATGSPGSSTPSGATGSPGASPGTSSTGSPTAEAAGC<br>GTAEAAR | 274 |
| Seg 83 | ATAEAAGCGTAEAAGASPGTSSTGSPGSSPSASTGTGPGSSPSASTGTGPGTPGSGTAS<br>SSPGSSTPSGATGSPGSSPSASTGTGPGASPGTSSTGSPGTPGSGTASSSPGSSTPSGATG<br>SPGTPGSGTASSSPGASPGTSSTGSPGASPGTSSTGSPGTPGSGTASSSPGSSTPSGATGS<br>PGASPGTSSTGSPGTPGSGTASSSPGSSTPSGATGSPGSSPSASTGTGP<br>GSSTPSGATGSPGSSTPSGATGSPGASPGTSSTGSPGASPGTSSTGSPGASPGTSSTGSPG<br>TPGSGTASSSPGASPGTSSTGSPGASPGTSSTGSPGASPGTSSTGSPGSSPSASTGTGPGT<br>PGSGTASSSPGASPGTSSTGSPGASPGTSSTGSPGASPGTSSTGSPGSSTPSGATGSPGSS<br>TPSGATGSPGASPGTSSTGSPGTPGSGTASSSPGSSTPSGATGSPGSSTPSGATGSPGSST<br>PSGATGSPGSSPSASTGTGPGASPGTSSTGSPGASPGTSSTGSPGTPGSGTASSSPGASPG | 275 |

TABLE 3-continued

Cysteine- and lysine-engineered XTEN

| Name | Amino Acid Sequence | SEQ ID NO: |
|---|---|---|
| | TSSTGSPGASPGTSSTGSPGASPGTSSTGSPGASPGTSSTGSPGTPGSGTASSSPGSSTPS<br>GATGSPGTPGSGTASSSPGSSTPSGATGSPGTPGSGTASSSPGSSTPSGATGSPGSSTPSG<br>ATGSPGSSPSASTGTGPGSSPSASTGTGPGASPGTSSTGSPGTPGSGTASSSPGSSTPSGA<br>TGSPGSSPSASTGTGPGSSPSASTGTGPGASPGTSSTGSPGASPGTSSTGSPGSSTPSGAT<br>GSPGSSPSASTGTGPGASPGTSSTGSPGSSPSASTGTGPGTPGSGTASSSPGSSTPSGATG<br>SPGSSTPSGATGSPGASPGTSSTGSPR | |
| Seg 84 | AGASPGTSSTGSPGSSPSASTGTGPGSSPSASTGTGPGTPGSGTASSSPGSSTPSGATGSP<br>GSSPSASTGTGPGASPGTSSTGSPGTPGSGTASSSPGSSTPSGATGSPGTPGSGTASSSPG<br>ASPGTSSTGSPGASPGTSSTGSPGTPGSGTASSSPGSSTPSGATGSPGASPGTSSTGSPGT<br>PGSGTASSSPGSSTPSGATGSPGSSPSASTGTGPGSSPSASTGTGPGSSTPSGATGSPGSS<br>TPSGATGSPGASPGTSSTGSPGASPGTSSTGSPGASPGTSSTGSPGTPGSGTASSSPGASP<br>GTSSTGSPGASPGTSSTGSPGASPGTSSTGSPGSSPSASTGTGPGTPGSGTASSSPGASPG<br>TSSTGSPGASPGTSSTGSPGASPGTSSTGSPGSSTPSGATGSPGSSTPSGATGSPGASPGT<br>SSTGSPGTPGSGTASSSPGSSTPSGATGSPGSSTPSGATGSPGSSTPSGATGSPGSSPSAS<br>TGTGPGASPGTSSTGSPGASPGTSSTGSPGTPGSGTASSSPGASPGTSSTGSPGASPGTSS<br>TGSPGASPGTSSTGSPGASPGTSSTGSPGTPGSGTASSSPGSSTPSGATGSPGTPGSGTAS<br>SSPGSSTPSGATGSPGTPGSGTASSSPGSSTPSGATGSPGSSTPSGATGSPGSSPSASTGT<br>GPGSSPSASTGTGPGASPGTSSTGSPGTPGSGTASSSPGSSTPSGATGSPGSSPSASTGTG<br>PGSSPSASTGTGPGASPGTSSTGSPGASPGTSSTGSPGSSTPSGATGSPGSSPSASTGTGP<br>GASPGTSSTGSPGSSPSASTGTGPGTPGSGTASSSPGSSTPSGATGSPGSSTPSGATGSPG<br>ASPGTSSTGSPTAEAAGCGTAEAAR | 276 |
| Seg 85 | ATAEAAGCGTAEAAGASPGTSSTGSPGSSPSASTGTGPGSSPSASTGTGPGTPGSGTAS<br>SSPGSSTPSGATGSPGSSPSASTGTGPGASPGTSSTGSPGTPGSGTASSSPGSSTPSGATG<br>SPGTPGSGTASSSPGASPGTSSTGSPGASPGTSSTGSPGTPGSGTASSSPGSSTPSGATGS<br>PGASPGTSSTGSPGTPGSGTASSSPGSSTPSGATGSPGSSPSASTGTGPGSSPSASTGTGP<br>GSSTPSGATGSPGSSTPSGATGSPGASPGTSSTGSPGASPGTSSTGSPGASPGTSSTGSPG<br>TPGSGTASSSPGASPGTSSTGSPGASPGTSSTGSPGASPGTSSTGSPGSSPSASTGTGPGT<br>PGSGTASSSPGASPGTSSTGSPGASPGTSSTGSPGASPGTSSTGSPGSSTPSGATGSPGSS<br>TPSGATGSPGASPGTSSTGSPTAEAAGCGTAEAAGTPGSGTASSSPGSSTPSGATGSPG<br>SSTPSGATGSPGSSTPSGATGSPGSSPSASTGTGPGASPGTSSTGSPGASPGTSSTGSPGT<br>PGSGTASSSPGASPGTSSTGSPGASPGTSSTGSPGASPGTSSTGSPGASPGTSSTGSPGTP<br>GSGTASSSPGSSTPSGATGSPGTPGSGTASSSPGSSTPSGATGSPGTPGSGTASSSPGSST<br>PSGATGSPGSSTPSGATGSPGSSPSASTGTGPGSSPSASTGTGPGASPGTSSTGSPGTPGS<br>GTASSSPGSSTPSGATGSPGSSPSASTGTGPGSSPSASTGTGPGASPGTSSTGSPGASPGT<br>SSTGSPGSSTPSGATGSPGSSPSASTGTGPGASPGTSSTGSPGSSPSASTGTGPGTPGSGT<br>ASSSPGSSTPSGATGSPGSSTPSGATGSPGASPGTSSTGSPR | 277 |
| Seg 86 | AGASPGTSSTGSPGSSPSASTGTGPGSSPSASTGTGPGTPGSGTASSSPGSSTPSGATGSP<br>GSSPSASTGTGPGASPGTSSTGSPGTPGSGTASSSPGSSTPSGATGSPGTPGSGTASSSPG<br>ASPGTSSTGSPGASPGTSSTGSPGTPGSGTASSSPGSSTPSGATGSPGASPGTSSTGSPGT<br>PGSGTASSSPGSSTPSGATGSPGSSPSASTGTGPGSSPSASTGTGPGSSTPSGATGSPGSS<br>TPSGATGSPGASPGTSSTGSPGASPGTSSTGSPGASPGTSSTGSPGTPGSGTASSSPGASP<br>GTSSTGSPGASPGTSSTGSPGASPGTSSTGSPGSSPSASTGTGPGTPGSGTASSSPGASPG<br>TSSTGSPGASPGTSSTGSPGASPGTSSTGSPGSSTTAEAAGCGTAEAAPSGATGSPGSST<br>PSGATGSPGASPGTSSTGSPGTPGSGTASSSPGSSTPSTAEAAGCGTAEAAGATGSPGSS<br>TPSGATGSPGSSTPSGATGSPGSSPSASTGTGPGASPGTSSTGSPGASPGTSSTGSPGTPG<br>SGTASSSPGASPGTSSTGSPGASPGTSSTGSPGASPGTSSTGSPGASPGTSSTGSPGTPGS<br>GTASSSPGSSTPSGATGSPGTPGSGTASSSPGSSTPSGATGSPGTPGSGTASSSPGSSTPS<br>GATGSPGSSTPSGATGSPGSSPSASTGTGPGSSPSASTGTGPGASPGTSSTGSPGTPGSG<br>TASSSPGSSTPSGATGSPGSSPSASTGTGPGSSPSASTGTGPGASPGTSSTGSPGASPGTS<br>STGSPGSSTPSGATGSPGSSPSASTGTGPGASPGTSSTGSPGSSPSASTGTGPGTPGSGTA<br>SSSPGSSTPSGATGSPGSSTPSGATGSPGASPGTSSTGSPR | 278 |
| Seg 87 | AGASPGTSSTGSPGSSPSASTGTGPGSSPSASTGTGPGTPGSGTASSSPGSSTPSGATGSP<br>GSSPSASTGTGPGASPGTSSTGSPGTPGSGTASSSPGSSTPSGATGSPGTPGSGTASSSPG<br>ASPGTSSTGSPGASPGTSSTGSPGTPGSGTASSSPGSSTPSGATGSPGASPGTSSTGSPGT<br>PGSGTASSSPGSSTPSGATGSPGSSPSASTGTGPGSSPSASTGTGPGSSTPSGATGSPGSS<br>TPSGATGSPGASPGTSSTGSPGASPGTSSTGSPGASPGTSSTGSPGTPGSGTASSSPGASP<br>GTSSTGSPGASPGTSSTGSPGASPGTSSTGSPGSSPSASTGTGPGTPGSGTASSSPGASPG<br>TSSTGSPGASPGTSSTGSPGASPGTSSTGSPGSSTPSGATGSPGSSTPSGATGSPGASPGT<br>SSTGSPTAEAAGCGTAEAAGTPGSGTASSSPGSSTPSGATGSPGSSTPSGATGSPGSSTP<br>SGATGSPGSSPSASTGTGPGASPGTSSTGSPGASPGTSSTGSPGTPGSGTASSSPGASPG<br>TSSTGSPGASPGTSSTGSPGASPGTSSTGSPGASPGTSSTGSPGTPGSGTASSSPGSSTPS<br>GATGSPGTPGSGTASSSPGSSTPSGATGSPGTPGSGTASSSPGSSTPSGATGSPGSSTPSG<br>ATGSPGSSPSASTGTGPGSSPSASTGTGPGASPGTSSTGSPGASPGTSSTGSPGSSTPSGA<br>TGSPGSSPSASTGTGPGASPGTSSTGSPGSSPSASTGTGPGTPGSGTASSSPGSSTPSGAT<br>GSPGSSPSASTGTGPGASPGTSSTGSPGSSPSASTGTGPGTPGSGTASSSPGSSTPSGATG<br>SPGSSTPSGATGSPGASPGTSSTGSPTAEAAGCGTAEAAR | 279 |
| Seg 88 | AGASPGTSSTGSPGSSPSASTGTGPGSSPSASTGTGPGTPGSGTASSSPGSSTPSGATGSP<br>GSSPSASTGTGPGASPGTSSTGSPGTPGSGTASSSPGSSTPSGATGSPGTPGSGTASSSPG<br>ASPGTSSTGSPGASPGTSSTGSPGTPGSGTASSSPGSSTPSGATGSPGASPGTSSTGSPGT<br>PGSGTASSSPGSSTPSGATGSPGSSPSASTGTGPGSSPSASTGTGPGSSTPSGATGSPGSS<br>TPSGATGSPGASPGTSSTGSPGASPGTSSTGSPGASPGTSSTGSPGTPGSGTASSSPGASP | 280 |

TABLE 3-continued

Cysteine- and lysine-engineered XTEN

| Name | Amino Acid Sequence | SEQ ID NO: |
|---|---|---|
|  | GTSSTGSPGASPGTSSTGSPGASPGTSSTGSPGSSPSASTGTGPGTPGSGTASSSPGASPG<br>TSSTGSPGASPGTSSTGSPGASPGTSSTGSPGSSTPSGATGSPGSSTPSGATGSPGASPGT<br>SSTGSPGGKPGGTPGSGTASSSPGSSTPSGATGSPGSSTPSGATGSPGSSTPSGATGSPGS<br>SPSASTGTGPGASPGTSSTGSPGASPGTSSTGSPGTPGSGTASSSPGASPGTSSTGSPGAS<br>PGTSSTGSPGASPGTSSTGSPGASPGTSSTGSPGTPGSGTASSSPGSSTPSGATGSPGTPG<br>SGTASSSPGSSTPSGATGSPGTPGSGTASSSPGSSTPSGATGSPGSSTPSGATGSPGSSPS<br>ASTGTGPGSSPSASTGTGPGASPGTSSTGSPGTPGSGTASSSPGSSTPSGATGSPGSSPSA<br>STGTGPGSSPSASTGTGPGASPGTSSTGSPGASPGTSSTGSPGSSTPSGATGSPGSSPSAS<br>TGTGPGASPGTSSTGSPGSSPSASTGTGPGTPGSGTASSSPGSSTPSGATGSPGSSTPSGA<br>TGSPGASPGTSSTGSPR |  |
| Seg 89 | AGGKPGGASPGTSSTGSPGSSPSASTGTGPGSSPSASTGTGPGTPGSGTASSSPGSSTPS<br>GATGSPGSSPSASTGTGPGASPGTSSTGSPGTPGSGTASSSPGSSTPSGATGSPGTPGSG<br>TASSSPGASPGTSSTGSPGASPGTSSTGSPGTPGSGTASSSPGSSTPSGATGSPGASPGTS<br>STGSPGTPGSGTASSSPGSSTPSGATGSPGSSPSASTGTGPGSSPSASTGTGPGSSTPSGA<br>TGSPGSSTPSGATGSPGASPGTSSTGSPGASPGTSSTGSPGASPGTSSTGSPGTPGSGTAS<br>SSPGASPGTSSTGSPGASPGTSSTGSPGASPGTSSTGSPGSSPSASTGTGPGTPGSGTASS<br>SPGASPGTSSTGSPGASPGTSSTGSPGASPGTSSTGSPGSSTPSGATGSPGSSTPSGATGS<br>PGASPGTSSTGSPGTPGSGTASSSPGSSTPSGATGSPGSSTPSGATGSPGSSTPSGATGSP<br>GSSPSASTGTGPGASPGTSSTGSPGASPGTSSTGSPGTPGSGTASSSPGASPGTSSTGSPG<br>ASPGTSSTGSPGASPGTSSTGSPGASPGTSSTGSPGTPGSGTASSSPGSSTPSGATGSPGT<br>PGSGTASSSPGSSTPSGATGSPGTPGSGTASSSPGSSTPSGATGSPGSSTPSGATGSPGSS<br>PSASTGTGPGSSPSASTGTGPGASPGTSSTGSPGTPGSGTASSSPGSSTPSGATGSPGSSP<br>SASTGTGPGSSPSASTGTGPGASPGTSSTGSPGASPGTSSTGSPGSSTPSGATGSPGSSPS<br>ASTGTGPGASPGTSSTGSPGSSPSASTGTGPGTPGSGTASSSPGSSTPSGATGSPGSSTPS<br>GATGSPGASPGTSSTGSPGGKPGR | 281 |
| Seg 90 | AGGKPGGASPGTSSTGSPGSSPSASTGTGPGSSPSASTGTGPGTPGSGTASSSPGSSTPS<br>GATGSPGSSPSASTGTGPGASPGTSSTGSPGTPGSGTASSSPGSSTPSGATGSPGTPGSG<br>TASSSPGASPGTSSTGSPGASPGTSSTGSPGTPGSGTASSSPGSSTPSGATGSPGASPGTS<br>STGSPGTPGSGTASSSPGSSTPSGATGSPGSSPSASTGTGPGSSPSASTGTGPGSSTPSGA<br>TGSPGSSTPSGATGSPGASPGTSSTGSPGASPGTSSTGSPGASPGTSSTGSPGTPGSGTAS<br>SSPGASPGTSSTGSPGASPGTSSTGSPGASPGTSSTGSPGSSPSASTGTGPGTPGSGTASS<br>SPGASPGTSSTGSPGASPGTSSTGSPGASPGTSSTGSPGSSTPSGATGSPGSSTPSGATG<br>PGASPGTSSTGSPGGKPGGTPGSGTASSSPGSSTPSGATGSPGSSTPSGATGSPGSSTPSG<br>ATGSPGSSPSASTGTGPGASPGTSSTGSPGASPGTSSTGSPGTPGSGTASSSPGASPGTSS<br>TGSPGASPGTSSTGSPGASPGTSSTGSPGASPGTSSTGSPGTPGSGTASSSPGSSTPSGAT<br>GSPGTPGSGTASSSPGSSTPSGATGSPGTPGSGTASSSPGSSTPSGATGSPGSSTPSGATG<br>SPGSSPSASTGTGPGSSPSASTGTGPGASPGTSSTGSPGTPGSGTASSSPGSSTPSGATGS<br>PGSSPSASTGTGPGSSPSASTGTGPGASPGTSSTGSPGASPGTSSTGSPGSSTPSGATGSP<br>GSSPSASTGTGPGASPGTSSTGSPGSSPSASTGTGPGTPGSGTASSSPGSSTPSGATGSPG<br>SSTPSGATGSPGASPGTSSTGSPGGKPGR | 282 |
| Seg 91 | AGGKPGGASPGTSSTGSPGSSPSASTGTGPGSSPSASTGTGPGTPGSGTASSSPGSSTPS<br>GATGSPGSSPSASTGTGPGASPGTSSTGSPGTPGSGTASSSPGSSTPSGATGSPGTPGSG<br>TASSSPGASPGTSSTGSPGASPGTSSTGSPGTPGSGTASSSPGSSTPSGATGSPGASPGTS<br>STGSPGTPGSGTASSSPGSSTPSGATGSPGSSPSASTGTGPGSSPSASTGTGPGSSTPSGA<br>TGSPGSSTPSGATGSPGASPGTSSTGSPGASPGTSSTGSPGASPGTSSTGSPGGKPGGTP<br>GSGTASSSPGASPGTSSTGSPGASPGTSSTGSPGASPGTSSTGSPGSSPSASTGTGPGTPG<br>SGTASSSPGASPGTSSTGSPGASPGTSSTGSPGASPGTSSTGSPGSSTPSGATGSPGSSTP<br>SGATGSPGASPGTSSTGSPGTPGSGTASSSPGSSTPSGATGSPGSSTPSGATGSPGSSTPS<br>GATGSPGSSPSASTGTGPGASPGTSSTGSPGASPGTSSTGSPGTPGSGTASSSPGASPGT<br>SSTGSPGASPGTSSTGSPGASPGTSSTGSPGASPGTSSTGSPGGKPGGTPGSGTASSSPGS<br>STPSGATGSPGTPGSGTASSSPGSSTPSGATGSPGTPGSGTASSSPGSSTPSGATGSPGSS<br>TPSGATGSPGSSPSASTGTGPGSSPSASTGTGPGASPGTSSTGSPGTPGSGTASSSPGSST<br>PSGATGSPGSSPSASTGTGPGSSPSASTGTGPGASPGTSSTGSPGASPGTSSTGSPGSSTP<br>SGATGSPGSSPSASTGTGPGASPGTSSTGSPGSSPSASTGTGPGTPGSGTASSSPGSSTPS<br>GATGSPGSSTPSGATGSPGASPGTSSTGSPGGKPGR | 283 |
| Seg 92 | AGGKPGGASPGTSSTGSPGSSPSASTGTGPGSSPSASTGTGPGTPGSGTASSSPGSSTPS<br>GATGSPGSSPSASTGTGPGASPGTSSTGSPGTPGSGTASSSPGSSTPSGATGSPGTPGSG<br>TASSSPGASPGTSSTGSPGASPGTSSTGSPGTPGSGTASSSPGSSTPSGATGSPGASPGTS<br>STGSPGTPGSGTASSSPGSSTPSGATGSPGSSPSASTGTGPGSSPSASTGTGPGSSSPGSS<br>TPSGATGSPGSSTPSGATGSPGASPGTSSTGSPGASPGTSSTGSPGASPGTSSTGSPGTPG<br>SGTASSSPGASPGTSSTGSPGASPGTSSTGSPGASPGTSSTGSPGSSPSASTGTGPGTPGS<br>GTASSSPGASPGTSSTGSPGASPGTSSTGSPGASPGTSSTGSPGSSTPSGATGSPGSSTPS<br>GATGSPGASPGTSSTGSPGGKPGGTPGSGTASSSPGSSTPSGATGSPGSSTPSGATGSPG<br>SSTPSGATGSPGSSPSASTGTGPGASPGTSSTGSPGASPGTSSTGSPGTPGSGTASSSPGA<br>SPGTSSTGSPGASPGTSSTGSPGASPGTSSTGSPGASPGTSSTGSPGTPGSGTASSSPGSS<br>TPSGATGSPGTPGSGTASSSPGSSTPSGATGSPGTPGSGTASSSPGSSTPSGATGSPGGK<br>PGGSSTPSGATGSPGSSPSASTGTGPGSSPSASTGTGPGASPGTSSTGSPGTPGSGTASSS<br>PGSSTPSGATGSPGSSPSASTGTGPGSSPSASTGTGPGASPGTSSTGSPGASPGTSSTGSP<br>GSSTPSGATGSPGSSPSASTGTGPGASPGTSSTGSPGSSPSASTGTGPGTPGSGTASSSPG<br>SSTPSGATGSPGSSTPSGATGSPGASPGTSSTGSPGGKPGR | 284 |

TABLE 3-continued

Cysteine- and lysine-engineered XTEN

| Name | Amino Acid Sequence | SEQ ID NO: |
| --- | --- | --- |
| Seg 93 | AGGKPGGASPGTSSTGSPGSSPSASTGTGPGSSPSASTGTGPGTPGSGTASSSPGSSTPS<br>GATGSPGSSPSASTGTGPGASPGTSSTGSPGTPGSGTASSSPGSSTPSGATGSPGTPGSG<br>TASSSPGASPGTSSTGSPGASPGTSSTGSPGTPGSGTASSSPGSSTPSGATGSPGASPGGG<br>KPGTSSTGSPGTPGSGTASSSPGSSTPSGATGSPGSSPSASTGTGPGSSPSASTGTGPGSS<br>TPSGATGSPGSSTPSGATGSPGASPGTSSTGSPGASPGTSSTGSPGASPGTSSTGSPGTPG<br>SGTASSSPGASPGTSSTGSPGASPGTSSTGSPGASPGTSSTGSPGSSPSASTGTGGKPGGP<br>GTPGSGTASSSPGASPGTSSTGSPGASPGTSSTGSPGASPGTSSTGSPGSSTPSGATGSPG<br>SSTPSGATGSPGASPGTSSTGSPGTPGSGTASSSPGSSTPSGATGSPGSSTPSGATGSPGS<br>STPSGATGSPGSSPSASTGTGPGASPGTSSTGSPGASPGTSSTGSPGTGGKPGPGSGTAS<br>SSPGASPGTSSTGSPGASPGTSSTGSPGASPGTSSTGSPGASPGTSSTGSPGTPGSGTASS<br>SPGSSTPSGATGSPGTPGSGTASSSPGSSTPSGATGSPGTPGSGTASSSPGSSTPSGATGS<br>PGSSTPSGATGSPGSSPSASTGTGPGSSPSASTGTGPGASPGTSGGKPGSTGSPGTPGSG<br>TASSSPGSSTPSGATGSPGSSPSASTGTGPGSSPSASTGTGPGASPGTSSTGSPGASPGTS<br>STGSPGSSTPSGATGSPGSSPSASTGTGPGASPGTSSTGSPGSSPSASTGTGPGTPGSGTA<br>SSSPGSSTPSGATGSPGSSTPSGATGSPGASPGTSSTGSPGGKPGR | 285 |
| Seg 94 | AGGKPGGASPGTSSTGSPGSSPSASTGTGPGSSPSASTGTGPGTPGSGTASSSPGSSTPS<br>GATGSPGSSPSASTGTGPGASPGTSSTGSPGTPGSGTASSSPGSSTPSGATGSPGTPGSG<br>TASSSPGASPGTSSTGSPGASPGTSSTGSPGGKPGGTPGSGTASSSPGSSTPSGATGSPG<br>ASPGTSSTGSPGTPGSGTASSSPGSSTPSGATGSPGSSPSASTGTGPGSSPSASTGTGPGS<br>STPSGATGSPGSSTPSGATGSPGASPGTSSTGSPGASPGTSSTGSPGASPGTSSTGSPGG<br>KPGGTPGSGTASSSPGASPGTSSTGSPGASPGTSSTGSPGASPGTSSTGSPGSSPSASTGT<br>GPGTPGSGTASSSPGASPGTSSTGSPGASPGTSSTGSPGASPGTSSTGSPGSSTPSGATGS<br>PGSSTPSGATGSPGASPGTSSTGSPGGKPGGTPGSGTASSSPGSSTPSGATGSPGSSTPSG<br>ATGSPGSSTPSGATGSPGSSPSASTGTGPGASPGTSSTGSPGASPGTSSTGSPGTPGSGT<br>ASSSPGASPGTSSTGSPGASPGTSSTGSPGASPGTSSTGSPGGKPGGTP<br>GSGTASSSPGSSTPSGATGSPGTPGSGTASSSPGSSTPSGATGSPGTPGSGTASSSPGSST<br>PSGATGSPGSSTPSGATGSPGSSPSASTGTGPGSSPSASTGTGPGASPGTSSTGSPGTPGS<br>GTASSSPGSSTPSGATGSPGGKPGGSSPSASTGTGPGSSPSASTGTGPGASPGTSSTGSP<br>GASPGTSSTGSPGSSTPSGATGSPGSSPSASTGTGPGASPGTSSTGSPGSSPSASTGTGPG<br>TPGSGTASSSPGSSTPSGATGSPGSSTPSGATGSPGASPGTSSTGSPGGKPGR | 286 |
| Seg 95 | AGGKPGGASPGTSSTGSPGSSPSASTGTGPGSSPSASTGTGPGTPGSGTASSSPGSSTPS<br>GATGSPGSSPSASTGTGPGASPGTSSTGSPGTPGSGTASSSPGSSTPSGATGSPGTPGSG<br>TASSSPGASGGKPGPGTSSTGSPGASPGTSSTGSPGTPGSGTASSSPGSSTPSGATGSPG<br>ASPGTSSTGSPGTPGSGTASSSPGSSTPSGATGSPGSSPSASTGTGPGSSPSASTGTGPGS<br>STPSGATGSPGSSTPSGGGKPGATGSPGASPGTSSTGSPGASPGTSSTGSPGASPGTSST<br>GSPGTPGSGTASSSPGASPGTSSTGSPGASPGTSSTGSPGASPGTSSTGSPGSSPSASTGT<br>GPGTPGSGTASSSPGASPGTSSTGGGKPGSPGASPGTSSTGSPGASPGTSSTGSPGSSTPS<br>GATGSPGSSTPSGATGSPGASPGTSSTGSPGTPGSGTASSSPGSSTPSGATGSPGSSTPSG<br>ATGSPGSSTPSGATGSPGSSPSASTGTGPGAGGKPGSPGTSSTGSPGASPGTSSTGSPGT<br>PGSGTASSSPGASPGTSSTGSPGASPGTSSTGSPGASPGTSSTGSPGTP<br>GSGTASSSPGSSTPSGATGSPGTPGSGTASSSPGSSTPGGKPGSGATGSPGTPGSGTASS<br>SPGSSTPSGATGSPGSSTPSGATGSPGSSPSASTGTGPGSSPSASTGTGPGASPGTSSTGS<br>PGTPGSGTASSSPGSSTPSGATGSPGSSPSASTGTGPGSSPSASTGGGKPGTGPGASPGT<br>SSTGSPGASPGTSSTGSPGSSTPSGATGSPGSSPSASTGTGPGASPGTSSTGSPGSSPSAS<br>TGTGPGTPGSGTASSSPGSSTPSGATGSPGSSTPSGATGSPGASPGTSSTGSPGGKPGR | 287 |
| Seg 96 | AGGKPGGASPGTSSTGSPGSSPSASTGTGPGSSPSASTGTGPGTPGSGTASSSPGSSTPS<br>GATGSPGSSPSASTGTGPGASPGTSSTGSPGTPGSGTASSSPGSSTPSGATGSPGTPGSG<br>TASSSPGASPGTSSTGSPGASPGTSSTGSPGTPGSGTASSSPGSSTPSGATGSPGASPGTS<br>STGSPGTPGSGTASSSPGSSTPSGATGSPGSSPSASTGTGPGSSPSASTGTGPGSSTPSGA<br>TGSPGSSTPSGATGSPGASPGTSSTGSPGASPGTSSTGSPGASPGTSSTGSPGTPGSGTAS<br>SSPGASPGTSSTGSPGASPGTSSTGSPGASPGTSSTGSPGASPGTSSTGSPGTPGSGTASS<br>SPGASPGTSSTGSPGASPGTSSTGSPGASPGTSSTGSPGSSTPSGATGSPGSSTPSGATGS<br>PGASPGTSSTGSPGTPGSGTASSSPGSSTPSGATGSPGSSTPSGATGSPGSSTPSGATGSP<br>GSSPSASTGTGPGASPGTSSTGSPGASPGTSSTGSPGTPGSGTASSSPGASPGTSSTGSPG<br>ASPGTSSTGSPGASPGTSSTGSPGASPGTSSTGSPGTPGSGTASSSPGSSTPSGATGSPGT<br>PGSGTASSSPGSSTPSGATGSPGTPGSGTASSSPGSSTPSGATGSPGSSTPSGATGSPGSS<br>PSASTGTGPGSSPSASTGTGPGASPGTSSTGSPGTPGSGTASSSPGSSTPSGATGSPGSSP<br>SASTGTGPGSSPSASTGTGPGASPGTSSTGSPGASPGTSSTGSPGSSTPSGATGSPGSSPS<br>ASTGTGPGASPGTSSTGSPGSSPSASTGTGPGTPGSGTASSSPGSSTPSGATGSPGSSTPS<br>GATGSPGASPGTSSTGSPR | 288 |
| Seg 97 | AGASPGTSSTGSPGSSPSASTGTGPGSSPSASTGTGPGTPGSGTASSSPGSSTPSGATGSP<br>GSSPSASTGTGPGASPGTSSTGSPGTPGSGTASSSPGSSTPSGATGSPGTPGSGTASSSPG<br>ASPGTSSTGSPGASPGTSSTGSPGTPGSGTASSSPGSSTPSGATGSPGASPGTSSTGSPGT<br>PGSGTASSSPGSSTPSGATGSPGSSPSASTGTGPGSSPSASTGTGPGSSTPSGATGSPGSS<br>TPSGATGSPGASPGTSSTGSPGASPGTSSTGSPGASPGTSSTGSPGTPGSGTASSSPGASP<br>GTSSTGSPGASPGTSSTGSPGASPGTSSTGSPGSSPSASTGTGPGTPGSGTASSSPGASPG<br>TSSTGSPGASPGTSSTGSPGASPGTSSTGSPGSSTPSGATGSPGSSTPSGATGSPGASPGT<br>SSTGSPGTPGSGTASSSPGSSTPSGATGSPGSSTPSGATGSPGSSTPSGATGSPGSSPSAS<br>TGTGPGASPGTSSTGSPGASPGTSSTGSPGTPGSGTASSSPGASPGTSSTGSPGASPGTSS<br>TGSPGASPGTSSTGSPGASPGTSSTGSPGTPGSGTASSSPGSSTPSGATGSPGTPGSGTAS<br>SSPGSSTPSGATGSPGTPGSGTASSSPGSSTPSGATGSPGSSTPSGATGSPGSSPSASTGT<br>GPGSSPSASTGTGPGASPGTSSTGSPGTPGSGTASSSPGSSTPSGATGSPGSSPSASTGTG | 289 |

TABLE 3-continued

Cysteine- and lysine-engineered XTEN

| Name | Amino Acid Sequence | SEQ ID NO: |
|---|---|---|
| | PGSSPSASTGTGPGASPGTSSTGSPGASPGTSSTGSPGSSTPSGATGSPGSSPSASTGTGP<br>GASPGTSSTGSPGSSPSASTGTGPGTPGSGTASSSPGSSTPSGATGSPGSSTPSGATGSPG<br>ASPGTSSTGSPGGKPGR | |
| Seg 98 | AGGKPGGASPGTSSTGSPGSSPSASTGTGPGSSPSASTGTGPGTPGSGTASSSPGSSTPS<br>GATGSPGSSPSASTGTGPGASPGTSSTGSPGTPGSGTASSSPGSSTPSGATGSPGTPGSG<br>TASSSPGASPGTSSTGSPGASPGTSSTGSPGTPGSGTASSSPGSSTPSGATGSPGASPGTS<br>STGSPGTPGSGTASSSPGSSTPSGATGSPGASPSASTGTGPGSSPSASTGTGPGSSTPGSGTA<br>TGSPGSSTPSGATGSPGASPGTSSTGSPGASPGTSSTGSPGASPGTSSTGSPGTPGSGTAS<br>SSPGASPGTSSTGSPGASPGTSSTGSPGASPGTSSTGSPGSSPSASTGTGPGTPGSGTASS<br>SPGASPGTSSTGSPGASPGTSSTGSPGASPGTSSTGSPGSSTPSGATGSPGSSTPSGATGS<br>PGASPGTSSTGSPGGKPGGTPGSGTASSSPGSSTPSGATGSPGSSTPSGATGSPGSSTPSG<br>ATGSPGSSPSASTGTGPGASPGTSSTGSPGASPGTSSTGSPGTPGSGTASSSPGASPGTSS<br>TGSPGASPGTSSTGSPGASPGTSSTGSPGASPGTSSTGSPGTPGSGTASSSPGSSTPSGAT<br>GSPGTPGSGTASSSPGSSTPSGATGSPGTPGSGTASSSPGSSTPSGATGSPGSSTPSGATG<br>SPGSSPSASTGTGPGSSPSASTGTGPGASPGTSSTGSPGTPGSGTASSSPGSSTPSGATGS<br>PGSSPSASTGTGPGSSPSASTGTGPGASPGTSSTGSPGASPGTSSTGSPGSSTPSGATGSP<br>GSSPSASTGTGPGASPGTSSTGSPGSSPSASTGTGPGTPGSGTASSSPGSSTPSGATGSPG<br>SSTPSGATGSPGASPGTSSTGSPR | 290 |
| Seg 99 | AGASPGTSSTGSPGSSPSASTGTGPGSSPSASTGTGPGTPGSGTASSSPGSSTPSGATGSP<br>GSSPSASTGTGPGASPGTSSTGSPGTPGSGTASSSPGSSTPSGATGSPGTPGSGTASSSPG<br>ASPGTSSTGSPGASPGTSSTGSPGTPGSGTASSSPGSSTPSGATGSPGASPGTSSTGSPGT<br>PGSGTASSSPGSSTPSGATGSPGSSPSASTGTGPGSSPSASTGTGPGSSTPSGATGSPGSS<br>TPSGATGSPGASPGTSSTGSPGASPGTSSTGSPGASPGTPGSGTASSSPGASP<br>GTSSTGSPGASPGTSSTGSPGASPGTSSTGSPGSSPSASTGTGPGTPGSGTASSSPGASPG<br>TSSTGSPGASPGTSSTGSPGASPGTSSTGSPGSSTGGKPGPSGATGSPGSSTPSGATGSP<br>GASPGTSSTGSPGTPGSGTASSSPGSSTPSGGKPGGATGSPGSSTPSGATGSPGSSTPSG<br>ATGSPGSSPSASTGTGPGASPGTSSTGSPGASPGTSSTGSPGTPGSGTASSSPGASPGTSS<br>TGSPGASPGTSSTGSPGASPGTSSTGSPGASPGTSSTGSPGTPGSGTASSSPGSSTPSGAT<br>GSPGTPGSGTASSSPGSSTPSGATGSPGTPGSGTASSSPGSSTPSGATGSPGSSTPSGATG<br>SPGSSPSASTGTGPGSSPSASTGTGPGASPGTSSTGSPGTPGSGTASSSPGSSTPSGATGS<br>PGSSPSASTGTGPGSSPSASTGTGPGASPGTSSTGSPGASPGTSSTGSPGSSTPSGATGSP<br>GSSPSASTGTGPGASPGTSSTGSPGSSPSASTGTGPGTPGSGTASSSPGSSTPSGATGSPG<br>SSTPSGATGSPGASPGTSSTGSPR | 291 |
| Seg 100 | AGASPGTSSTGSPGSSPSASTGTGPGSSPSASTGTGPGTPGSGTASSSPGSSTPSGATGSP<br>GSSPSASTGTGPGASPGTSSTGSPGTPGSGTASSSPGSSTPSGATGSPGTPGSGTASSSPG<br>ASPGTSSTGSPGASPGTSSTGSPGTPGSGTASSSPGSSTPSGATGSPGASPGTSSTGSPGT<br>PGSGTASSSPGSSTPSGATGSPGSSPSASTGTGPGSSPSASTGTGPGSSTPSGATGSPGSS<br>TPSGATGSPGASPGTSSTGSPGASPGTSSTGSPGASPGTSSTGSPGTPGSGTASSSPGASP<br>GTSSTGSPGASPGTSSTGSPGASPGTSSTGSPGSSPSASTGTGPGTPGSGTASSSPGASPG<br>TSSTGSPGASPGTSSTGSPGASPGTSSTGSPGSSTPSGATGSPGSSTPSGATGSPGASPGT<br>SSTGSPGGKPGGTPGSGTASSSPGSSTPSGATGSPGSSTPSGATGSPGSSTPSGATGSPGS<br>SPSASTGTGPGASPGTSSTGSPGASPGTSSTGSPGTPGSGTASSSPGASPGTSSTGSPGAS<br>PGTSSTGSPGASPGTSSTGSPGASPGTSSTGSPGTPGSGTASSSPGSSTPSGATGSPGTPG<br>SGTASSSPGSSTPSGATGSPGTPGSGTASSSPGSSTPSGATGSPGSSTPSGATGSPGSSPS<br>ASTGTGPGSSPSASTGTGPGASPGTSSTGSPGTPGSGTASSSPGSSTPSGATGSPGSSPSA<br>STGTGPGSSPSASTGTGPGASPGTSSTGSPGASPGTSSTGSPGSSTPSGATGSPGSSPSAS<br>TGTGPGASPGTSSTGSPGSSPSASTGTGPGTPGSGTASSSPGSSTPSGATGSPGSSTPSGA<br>TGSPGASPGTSSTGSPGGKPGR | 292 |
| Seg 101 | AEATTAAGGAGASPGTSSTGSPGSSPSASTGTGPGSSPSASTGTGPGTPGSGTASSSPGS<br>STPSGATGSPGSSPSASTGTGPGASPGTSSTGSPGTPGSGTASSSPGSSTPSGATGSPG<br>GSGTASSSPGASPGTSSTGSPGASPGTSSTGSPGTPGSGTASSSPGSSTPSGATGSPGASP<br>GTSSTGSPGTPGSGTASSSPGSSTPSGATGSPGSSPSASTGTGPGSSPSASTGTGPGSSTP<br>SGATGSPGSSTPSGATGSPGASPGTSSTGSPGASPGTSSTGSPGASPGTSSTGSPGTPGS<br>GTASSSPGASPGTSSTGSPGASPGTSSTGSPGASPGTSSTGSPGSSPSASTGTGPGTPGSG<br>TASSSPGASPGTSSTGSPGASPGTSSTGSPGTAEAAGCGTAEAAGTPGSGTASSSPGSSTP<br>SGATGSPGASPGTSSTGSPTAEAAGCGTAEAAGTPGSGTASSSPGSSTPSGATGSPGSSTPS<br>GATGSPGSSTPSGATGSPGSSPSASTGTGPGASPGTSSTGSPGASPGTSSTGSPGTPGSG<br>TASSSPGASPGTSSTGSPGASPGTSSTGSPGASPGTSSTGSPGASPGTSSTGSPGTPGSGT<br>ASSSPGSSTPSGATGSPGTPGSGTASSSPGSSTPSGATGSPGSSTPSGATGSPGSSTPGA<br>TGSPGSSTPSGATGSPGSSPSASTGTGPGSSPSASTGTGPGASPGTSSTGSPGTPGSGTAS<br>SSPGSSTPSGATGSPGSSPSASTGTGPGSSPSASTGTGPGASPGTSSTGSPGASPGTSSTG<br>SPGSSTPSGATGSPGSSPSASTGTGPGASPGTSSTGSPGSSPSASTGTGPGTPGSGTASSS<br>PGSSTPSGATGSPGSSTPSGATGSPGASPGTSSTGSPR | 293 |
| Seg 102 | AEATTAAGGATAEAAGCGTAEAAGASPGTSSTGSPGSSPSASTGTGPGSSPSASTGTG<br>PGTPGSGTASSSPGSSTPSGATGSPGSSPSASTGTGPGASPGTSSTGSPGTPGSGTASSSP<br>GSSTPSGATGSPGTPGSGTASSSPGASPGTSSTGSPGASPGTSSTGSPGTPGSGTASSSPG<br>SSTPSGATGSPGASPGTSSTGSPGTPGSGTASSSPGSSTPSGATGSPGSSPSASTGTGPGS<br>SPSASTGTGPGSSTPSGATGSPGSSTPSGATGSPGASPGTSSTGSPGASPGTSSTGSPGAS<br>PGTSSTGSPGTPGSGTASSSPGASPGTSSTGSPGASPGTSSTGSPGASPGTSSTGSPGSSP<br>SASTGTGPGTPGSGTASSSPGASPGTSSTGSPGASPGTSSTGSPGASPGTSSTGSPGSSTP<br>SGATGSPGSSTPSGATGSPGASPGTSSTGSPGTPGSGTASSSPGSSTPSGATGSPGSSTPS | 294 |

TABLE 3-continued

Cysteine- and lysine-engineered XTEN

| Name | Amino Acid Sequence | SEQ ID NO: |
|---|---|---|
| | GATGSPGSSTPSGATGSPGSSPSASTGTGPGASPGTSSTGSPGASPGTSSTGSPGTPGSG TASSSPGASPGTSSTGSPGASPGTSSTGSPGASPGTSSTGSPGASPGTSSTGSPGTPGSGT ASSSPGSSTPSGATGSPGTPGSGTASSSPGSSTPSGATGSPGTPGSGTASSSPGSSTPSGA TGSPGSSTPSGATGSPGSSPSASTGTGPGSSPSASTGTGPGASPGTSSTGSPGTPGSGTAS SSPGSSTPSGATGSPGSSPSASTGTGPGSSPSASTGTGPGASPGTSSTGSPGASPGTSSTG SPGSSTPSGATGSPGSSPSASTGTGPGASPGTSSTGSPGSSPSASTGTGPGTPGSGTASSS PGSSTPSGATGSPGSSTPSGATGSPGASPGTSSTGSPTAEAAGCGTAEAAR | |
| Seg 103 | AEATTAAGGATAEAAGCGTAEAAGASPGTSSTGSPGSSPSASTGTGPGSSPSASTGTG PGTPGSGTASSSPGSSTPSGATGSPGSSPSASTGTGPGASPGTSSTGSPGTPGSGTASSSP GSSTPSGATGSPGTPGSGTASSSPGASPGTSSTGSPGASPGTSSTGSPGTPGSGTASSSPG SSTPSGATGSPGASPGTSSTGSPGTPGSGTASSSPGSSTPSGATGSPGSSPSASTGTGPGS SPSASTGTGPGSSTPSGATGSPGSSTPSGATGSPGASPGTSSTGSPGASPGTSSTGSPGAS PGTSSTGSPGTPGSGTASSSPGASPGTSSTGSPGASPGTSSTGSPGASPGTSSTGSPGSSP SASTGTGPGTPGSGTASSSPGASPGTSSTGSPGASPGTSSTGSPGASPGTSSTGSPGSSTP SGATGSPGSSTPSGATGSPGASPGTSSTGSPTAEAAGCGTAEAAGTPGSGTASSSPGSS TPSGATGSPGSSTPSGATGSPGSSPSASTGTGPGASPGTSSTGSPGASP GTSSTGSPGTPGSGTASSSPGASPGTSSTGSPGASPGTSSTGSPGASPGTSSTGSPGASPG TSSTGSPGTPGSGTASSSPGSSTPSGATGSPGTPGSGTASSSPGSSTPSGATGSPGTPGSG TASSSPGSSTPSGATGSPGSSTPSGATGSPGSSPSASTGTGPGSSPSASTGTGPGASPGTS STGSPGTPGSGTASSSPGSSTPSGATGSPGSSPSASTGTGPGASPGTSSTGPGASPGTSS TGSPGASPGTSSTGSPGSSTPSGATGSPGSSPSASTGTGPGASPGTSSTGSPGSSPSASTG TGPGTPGSGTASSSPGSSTPSGATGSPGSSTPSGATGSPGASPGTSSTGSPTAEAAGCGT AEAAR | 295 |
| Seg 104 | AEATTAAGGATAEAAGCGTAEAAGASPGTSSTGSPGSSPSASTGTGPGSSPSASTGTG PGTPGSGTASSSPGSSTPSGATGSPGSSPSASTGTGPGASPGTSSTGSPGTPGSGTASSSP GSSTPSGATGSPGTPGSGTASSSPGASPGTSSTGSPGASPGTSSTGSPGTPGSGTASSSPG SSTPSGATGSPGASPGTSSTGSPGTPGSGTASSSPGSSTPSGATGSPGSSPSASTGTGPGS SPSASTGTGPGSSTPSGATGSPGSSTPSGATGSPGASPGTSSTGSPGASPGTSSTGSPGAS PGTSSTGSPTAEAAGCGTAEAAGTPGSGTASSSPGASPGTSSTGSPGASPGTSSTGSPG ASPGTSSTGSPGSSPSASTGTGPGTPGSGTASSSPGASPGTSSTGSPGASPGTSSTGSPGA SPGTSSTGSPGSSTPSGATGSPGSSTPSGATGSPGASPGTSSTGSPGTPGSGTASSSPGSS TPSGATGSPGSSTPSGATGSPGSSPSASTGTGPGASPGTSSTGSPGASP GTSSTGSPGTPGSGTASSSPGASPGTSSTGSPGASPGTSSTGSPGASPGTSSTGSPGASPG TSSTGSPTAEAAGCGTAEAAGTPGSGTASSSPGSSTPSGATGSPGTPGSGTASSSPGSST PSGATGSPGTPGSGTASSSPGSSTPSGATGSPGSSTPSGATGSPGSSPSASTGTGPGSSPS ASTGTGPGASPGTSSTGSPGTPGSGTASSSPGSSTPSGATGSPGSSPSASTGTGPGSSPSA STGTGPGASPGTSSTGSPGASPGTSSTGSPGSSTPSGATGSPGSSPSASTGTGPGASPGTS STGSPGSSPSASTGTGPGTPGSGTASSSPGSSTPSGATGSPGSSTPSGATGSPGASPGTSS TGSPTAEAAGCGTAEAAR | 296 |
| Seg 105 | ATGTATSEGSPEGASPGTSSTGSPGSSPSASTGTGPGSSPSASTGTGPGTPGSGTASSSP GSSTPSGATGSPGSSPSASTGTGPGASPGTSSTGSPGTPGSGTASSSPGSSTPSGATGSPG TPGSGTASSSPGASPGTSSTGSPGASPGTSSTGSPGTPGSGTASSSPGSSTPSGATGSPGA SPGTSSTGSPGTPGSGTASSSPGSSTPSGATGSPGSSPSASTGTGPGSSPSASTGTGPGSS TPSGATGSPGSSTPSGATGSPGASPGTSSTGSPGASPGTSSTGSPGASPGTSSTGSPGTPG SGTASSSPGASPGTSSTGSPGASPGTSSTGSPGASPGTSSTGSPGSSPSASTGTGPGTPGS GTASSSPGASPGTSSTGSPGASPGTSSTGSPGASPGTSSTGSPGSSTPSGATGSPGSSTPS GATGSPGASPGTSSTGSPTAEAAGCGTAEAAGTPGSGTASSSPGSSTPSGATGSPGSST PSGATGSPGSSTPSGATGSPGSSPSASTGTGPGASPGTSSTGSPGASPGTSSTGSPGTPGS GTASSSPGASPGTSSTGSPGASPGTSSTGSPGASPGTSSTGSPGASPGTSSTGSPGTPGSG TASSSPGSSTPSGATGSPGTPGSGTASSSPGSSTPSGATGSPGTPGSGTASSSPGSSTPSG ATGSPGSSTPSGATGSPGSSPSASTGTGPGSSPSASTGTGPGASPGTSSTGSPGTPGSGT ASSSPGSSTPSGATGSPGSSPSASTGTGPGSSPSASTGTGPGASPGTSSTGSPGASPGTSS TGSPGSSTPSGATGSPGSSPSASTGTGPGASPGTSSTGSPGSSPSASTGTGPGTPGSGTAS SSPGSSTPSGATGSPGSSTPSGATGSPGASPGTSSTGSPR | 297 |
| Seg 106 | ATGTATSEGSPETAEAAGCGTAEAAGASPGTSSTGSPGSSPSASTGTGPGSSPSASTGT GPGTPGSGTASSSPGSSTPSGATGSPGSSPSASTGTGPGASPGTSSTGSPGTPGSGTASSS PGSSTPSGATGSPGTPGSGTASSSPGASPGTSSTGSPGASPGTSSTGSPGTPGSGTASSSP GSSTPSGATGSPGASPGTSSTGSPGTPGSGTASSSPGSSTPSGATGSPGSSPSASTGTGPG SSPSASTGTGPGSSTPSGATGSPGSSTPSGATGSPGASPGTSSTGSPGASPGTSSTGSPGA SPGTSSTGSPGTPGSGTASSSPGASPGTSSTGSPGASPGTSSTGSPGASPGTSSTGSPGSS PSASTGTGPGTPGSGTASSSPGASPGTSSTGSPGASPGTSSTGSPGASPGTSSTGSPGSST PSGATGSPGSSTPSGATGSPGASPGTSSTGSPGTPGSGTASSSPGSSTPSGATGSPGSSTP SGATGSPGSSTPSGATGSPGSSPSASTGTGPGASPGTSSTGSPGTPGSGTASSSPGASPGT SSTPSGATGSPGSSPSASTGTGPGASPGTSSTGSPGASPGTSSTGSPGASPGTSSTGSPGT PGSGTASSSPGSSTPSGATGSPGTPGSGTASSSPGSSTPSGATGSPGTPGSGTASSSPGSST PSG ATGSPGSSTPSGATGSPGSSPSASTGTGPGSSPSASTGTGPGASPGTSSTGSPGTPGSGT ASSSPGSSTPSGATGSPGSSPSASTGTGPGSSPSASTGTGPGASPGTSSTGSPGASPGTSS TGSPGSSTPSGATGSPGSSPSASTGTGPGASPGTSSTGSPGSSPSASTGTGPGTPGSGTAS SSPGSSTPSGATGSPGSSTPSGATGSPGASPGTSSTGSPTAEAAGCGTAEAAR | 298 |
| Seg 107 | ATGTATSEGSPETAEAAGCGTAEAAGASPGTSSTGSPGSSPSASTGTGPGSSPSASTGT GPGTPGSGTASSSPGSSTPSGATGSPGSSPSASTGTGPGASPGTSSTGSPGTPGSGTASSS | 299 |

| Name | Amino Acid Sequence | SEQ ID NO: |
|---|---|---|
| | PGSSTPSGATGSPGTPGSGTASSSPGASPGTSSTGSPGASPGTSSTGSPGTPGSGTASSSP GSSTPSGATGSPGASPGTSSTGSPGTPGSGTASSSPGSSTPSGATGSPGSSPSASTGTGPG SSPSASTGTGPGSSTPSGATGSPGSSTPSGATGSPGASPGTSSTGSPGASPGTSSTGSPGA SPGTSSTGSPGTPGSGTASSSPGASPGTSSTGSPGASPGTSSTGSPGASPGTSSTGSPGSS PSASTGTGPGTPGSGTASSSPGASPGTSSTGSPGASPGTSSTGSPGASPGTSSTGSPGSST PSGATGSPGSSTPSGATGSPGASPGTSSTGSPTAEAAGCGTAEAAGTPGSGTASSSPGSS TPSGATGSPGSSTPSGATGSPGSSTPSGATGSPGSSPSASTGTGPGASPGTSSTGSPGASP GTSSTGSPGTPGSGTASSSPGASPGTSSTGSPGASPGTSSTGSPGASPG TSSTGSPGTPGSGTASSSPGSSTPSGATGSPGTPGSGTASSSPGSSTPSGATGSPGTPGSG TASSSPGSSTPSGATGSPGSSTPSGATGSPGSSPSASTGTGPGSSPSASTGTGPGASPGTS STGSPGTPGSGTASSSPGSSTPSGATGSPGSSPSASTGTGPGSSPSASTGTGPGASPGTSS TGSPGASPGTSSTGSPGSSTPSGATGSPGSSPSASTGTGPGASPGTSSTGSPGSSPSASTG TGPGTPGSGTASSSPGSSTPSGATGSPGSSTPSGATGSPGASPGTSSTGSPTAEAAGCGT AEAAR | |
| Seg 108 | ATGTATSEGSPETAEAAGCGTAEAAGASPGTSSTGSPGSSPSASTGTGPGSSPSASTGT GPGTPGSGTASSSPGSSTPSGATGSPGSSPSASTGTGPGASPGTSSTGSPGTPGSGTASSS PGSSTPSGATGSPGTPGSGTASSSPGASPGTSSTGSPGASPGTSSTGSPGTPGSGTASSSP GSSTPSGATGSPGASPGTSSTGSPGTPGSGTASSSPGSSTPSGATGSPGSSPSASTGTGPG SSPSASTGTGPGSSTPSGATGSPGSSTPSGATGSPGASPGTSSTGSPGASPGTSSTGSPGA SPGTSSTGSPTAEAAGCGTAEAAGTPGSGTASSSPGSSTPSGATGSPGSSTPSGATGSPG ASPGTSSTGSPGSSPSASTGTGPGTPGSGTASSSPGASPGTSSTGSPGASPGTSSTGSPGA SPGTSSTGSPGSSTPSGATGSPGSSTPSGATGSPGASPGTSSTGSPGTPGSGTASSSPGSS TPSGATGSPGSSTPSGATGSPGSSTPSGATGSPGSSPSASTGTGPGASPGTSSTGSPGASP GTSSTGSPGTPGSGTASSSPGASPGTSSTGSPGASPGTSSTGSPGASPGTSSTGSPGASPG TSSTGSPTAEAAGCGTAEAAGTPGSGTASSSPGSSTPSGATGSPGTPGSGTASSSPGSST PSGATGSPGTPGSGTASSSPGSSTPSGATGSPGSSTPSGATGSPGSSPSASTGTGPGSSPS ASTGTGPGASPGTSSTGSPGTPGSGTASSSPGSSTPSGATGSPGSSPSASTGTGPGSSPSA STGTGPGASPGTSSTGSPGASPGTSSTGSPGSSTPSGATGSPGSSPSASTGTGPGASPGTS STGSPGSSPSASTGTGPGTPGSGTASSSPGSSTPSGATGSPGSSTPSGATGSPGASPGTSS TGSPTAEAAGCGTAEAAR | 300 |
| Seg 109 | EPTAATTGESAGGASPGTSSTGSPGSSPSASTGTGPGSSPSASTGTGPGTPGSGTASSSP GSSTPSGATGSPGSSPSASTGTGPGASPGTSSTGSPGTPGSGTASSSPGSSTPSGATGSPG TPGSGTASSSPGASPGTSSTGSPGASPGTSSTGSPGTPGSGTASSSPGSSTPSGATGSPGA SPGTSSTGSPGTPGSGTASSSPGSSTPSGATGSPGSSPSASTGTGPGSSPSASTGTGPGSS TPSGATGSPGSSTPSGATGSPGASPGTSSTGSPGASPGTSSTGSPGASPGTSSTGSPGTPG SGTASSSPGASPGTSSTGSPGASPGTSSTGSPGASPGTSSTGSPGSSPSASTGTGPGSSPS GTASSSPGASPGTSSTGSPGASPGTSSTGSPGASPGTSSTGSPGSSTPSGATGSPGSSTPS GATGSPGASPGTSSTGSPTAEAAGCGTAEAAGTPGSGTASSSPGSSTPSGATGSPGSST PSGATGSPGSSTPSGATGSPGSSPSASTGTGPGASPGTSSTGSPGASPGTSSTGSPGTPGS GTASSSPGASPGTSSTGSPGASPGTSSTGSPGASPGTSSTGSPGTPGS TASSSPGSSTPSGATGSPGTPGSGTASSSPGSSTPSGATGSPGTPGSGTASSSPGSSTPSG ATGSPGSSTPSGATGSPGSSPSASTGTGPGSSPSASTGTGPGASPGTSSTGSPGTPGSGT ASSSPGSSTPSGATGSPGSSPSASTGTGPGSSPSASTGTGPGASPGTSSTGSPGASPGTSS TGSPGSSTPSGATGSPGSSPSASTGTGPGASPGTSSTGSPGSSPSASTGTGPGTPGSGTAS SSPGSSTPSGATGSPGSSTPSGATGSPGASPGTSSTGSPR | 301 |
| Seg 110 | EPTAATTGESAGTAEAAGCGTAEAAGASPGTSSTGSPGSSPSASTGTGPGSSPSASTGT GPGTPGSGTASSSPGSSTPSGATGSPGSSPSASTGTGPGASPGTSSTGSPGTPGSGTASSS PGSSTPSGATGSPGTPGSGTASSSPGASPGTSSTGSPGASPGTSSTGSPGTPGSGTASSSP GSSTPSGATGSPGASPGTSSTGSPGTPGSGTASSSPGSSTPSGATGSPGSSPSASTGTGPG SSPSASTGTGPGSSTPSGATGSPGSSTPSGATGSPGASPGTSSTGSPGASPGTSSTGSPGA SPGTSSTGSPGTPGSGTASSSPGASPGTSSTGSPGASPGTSSTGSPGASPGTSSTGSPGSS PSASTGTGPGTPGSGTASSSPGASPGTSSTGSPGASPGTSSTGSPGASPGTSSTGSPGSST PSGATGSPGSSTPSGATGSPGASPGTSSTGSPGTPGSGTASSSPGSSTPSGATGSPGSSTP SGATGSPGSSTPSGATGSPGSSPSASTGTGPGASPGTSSTGSPGASPGTSSTGSPGTPGS GTASSSPGASPGTSSTGSPGASPGTSSTGSPGASPGTSSTGSPGASPGTSSTGSPGTPGSG TASSSPGSSTPSGATGSPGTPGSGTASSSPGSSTPSGATGSPGTPGSG ATGSPGSSTPSGATGSPGSSPSASTGTGPGSSPSASTGTGPGASPGTSSTGSPGTPGSGT ASSSPGSSTPSGATGSPGSSPSASTGTGPGSSPSASTGTGPGASPGTSSTGSPGASPGTSS TGSPGSSTPSGATGSPGSSPSASTGTGPGASPGTSSTGSPGSSPSASTGTGPGTPGSGTAS SSPGSSTPSGATGSPGSSTPSGATGSPGASPGTSSTGSPTAEAAGCGTAEAAR | 302 |
| Seg 111 | EPTAATTGESAGTAEAAGCGTAEAAGASPGTSSTGSPGSSPSASTGTGPGSSPSASTGT GPGTPGSGTASSSPGSSTPSGATGSPGSSPSASTGTGPGASPGTSSTGSPGTPGSGTASSS PGSSTPSGATGSPGTPGSGTASSSPGASPGTSSTGSPGASPGTSSTGSPGTPGSGTASSSP GSSTPSGATGSPGASPGTSSTGSPGTPGSGTASSSPGSSTPSGATGSPGSSPSASTGTGPG SSPSASTGTGPGSSTPSGATGSPGSSTPSGATGSPGASPGTSSTGSPGASPGTSSTGSPGA SPGTSSTGSPGTPGSGTASSSPGASPGTSSTGSPGASPGTSSTGSPGASPGTSSTGSPGSS PSASTGTGPGTPGSGTASSSPGASPGTSSTGSPGASPGTSSTGSPGASPGTSSTGSPGSST PSGATGSPGSSTPSGATGSPGASPGTSSTGSPTAEAAGCGTAEAAGTPGSGTASSSPGSS TPSGATGSPGSSTPSGATGSPGSSTPSGATGSPGSSPSASTGTGPGASPGTSSTGSPGASP GTSSTGSPGTPGSGTASSSPGASPGTSSTGSPGASPGTSSTGSPGASPGTSSTGSPGASPG TSSTGSPGTPGSGTASSSPGSSTPSGATGSPGTPGSGTASSSPGSSTPSGATGSPGTPGSG TASSSPGSSTPSGATGSPGSSTPSGATGSPGSSPSASTGTGPGSSPSASTGTGPGASPGTS | 303 |

TABLE 3-continued

Cysteine- and lysine-engineered XTEN

| Name | Amino Acid Sequence | SEQ ID NO: |
|---|---|---|
| | STGSPGTPGSGTASSSPGSSTPSGATGSPGSSPSASTGTGPGSSPSASTGTGPGASPGTSS<br>TGSPGASPGTSSTGSPGSSTPSGATGSPGSSPSASTGTGPGASPGTSSTGSPGSSPSASTG<br>TGPGTPGSGTASSSPGSSTPSGATGSPGSSTPSGATGSPGASPGTSSTGSPTAEAAGCGT<br>AEAAR | |
| Seg 112 | EPTAATTGESAGTAEAAGCGTAEAAGASPGTSSTGSPGSSPSASTGTGPGSSPSASTGT<br>GPGTPGSGTASSSPGSSTPSGATGSPGSSPSASTGTGPGASPGTSSTGSPGTPGSGTASSS<br>PGSSTPSGATGSPGTPGSGTASSSPGASPGTSSTGSPGASPGTSSTGSPGTPGSGTASSSP<br>GSSTPSGATGSPGASPGTSSTGSPGTPGSGTASSSPGSSTPSGATGSPGSSPSASTGTGPG<br>SSPSASTGTGPGSSTPSGATGSPGSSTPSGATGSPGASPGTSSTGSPGASPGTSSTGSPGA<br>SPGTSSTGSPTAEAAGCGTAEAAGTPGSGTASSSPGASPGTSSTGSPGASPGTSSTGSPG<br>ASPGTSSTGSPGSSPSASTGTGPGTPGSGTASSSPGASPGTSSTGSPGASPGTSSTGSPGA<br>SPGTSSTGSPGSSTPSGATGSPGSSTPSGATGSPGASPGTSSTGSPGTPGSGTASSSPGSS<br>TPSGATGSPGSSTPSGATGSPGSSTPSGATGSPGSSPSASTGTGPGASPGTSSTGSPGASP<br>GTSSTGSPGTPGSGTASSSPGASPGTSSTGSPGASPGTSSTGSPGASPGTSSTGSPGASPG<br>TSSTGSPTAEAAGCGTAEAAGTPGSGTASSSPGSSTPSGATGSPGTPGSGTASSSPGSST<br>PSGATGSPGTPGSGTASSSPGSSTPSGATGSPGSSPSASTGTGPGSSPS<br>ASTGTGPGASPGTSSTGSPGTPGSGTASSSPGSSTPSGATGSPGSSPSASTGTGPGSSPSA<br>STGTGPGASPGTSSTGSPGASPGTSSTGSPGSSTPSGATGSPGSSPSASTGTGPGASPGTS<br>STGSPGSSPSASTGTGPGTPGSGTASSSPGSSTPSGATGSPGSSTPSGATGSPGASPGTSS<br>TGSPTAEAAGCGTAEAAR | 304 |
| Seg 113 | AEATTAAGGAEEEGASPGTSSTGSPGSSPSASTGTGPGSSPSASTGTGPGTPGSGTASSS<br>PGSSTPSGATGSPGSSPSASTGTGPGASPGTSSTGSPGTPGSGTASSSPGSSTPSGATGSP<br>GTPGSGTASSSPGASPGTSSTGSPGASPGTSSTGSPGTPGSGTASSSPGSSTPSGATGSP<br>ASPGTSSTGSPGTPGSGTASSSPGSSTPSGATGSPGSSPSASTGTGPGSSPSASTGTGPGS<br>STPSGATGSPGSSTPSGATGSPGASPGTSSTGSPGASPGTSSTGSPGASPGTSSTGSPGTP<br>GSGTASSSPGASPGTSSTGSPGASPGTSSTGSPGASPGTSSTGSPGSSPSASTGTGPGTPG<br>SGTASSSPGASPGTSSTGSPGASPGTSSTGSPGASPGTSSTGSPGSSPSASTGTGPGSSTP<br>SGATGSPGASPGTSSTGSPTAEAAGCGTAEAAGTPGSGTASSSPGSSTPSGATGSPGSS<br>TPSGATGSPGSSTPSGATGSPGSSPSASTGTGPGASPGTSSTGSPGASPGTSSTGSPGTPG<br>SGTASSSPGASPGTSSTGSPGASPGTSSTGSPGASPGTSSTGSPGASPGTSSTGSPGTPGS<br>GTASSSPGSSTPSGATGSPGTPGSGTASSSPGSSTPSGATGSPGTPGSGTASSSPGSSTPS<br>GATGSPGSSTPSGATGSPGSSPSASTGTGPGSSPSASTGTGPGASPGTSSTGSPGTPGSG<br>TASSSPGSSTPSGATGSPGSSPSASTGTGPGSSPSASTGTGPGASPGTSSTGSPGASPGTS<br>STGSPGSSTPSGATGSPGSSPSASTGTGPGASPGTSSTGSPGSSPSASTGTGPGTPGSGTA<br>SSSPGSSTPSGATGSPGSSTPSGATGSPGASPGTSSTGSPR | 305 |
| Seg 114 | AEATTAAGGAEEETAEAAGCGTAEAAGASPGTSSTGSPGSSPSASTGTGPGSSPSASTG<br>TGPGTPGSGTASSSPGSSTPSGATGSPGSSPSASTGTGPGASPGTSSTGSPGTPGSGTASS<br>SPGSSTPSGATGSPGTPGSGTASSSPGASPGTSSTGSPGASPGTSSTGSPGTPGSGTASSS<br>PGSSTPSGATGSPGASPGTSSTGSPGTPGSGTASSSPGSSTPSGATGSPGSSPSASTGTGP<br>GSSPSASTGTGPGSSTPSGATGSPGSSTPSGATGSPGASPGTSSTGSPGASPGTSSTGSPG<br>ASPGTSSTGSPGTPGSGTASSSPGASPGTSSTGSPGASPGTSSTGSPGASPGTSSTGSPGS<br>SPSASTGTGPGTPGSGTASSSPGASPGTSSTGSPGASPGTSSTGSPGASPGTSSTGSPGSS<br>TPSGATGSPGSSTPSGATGSPGASPGTSSTGSPGTPGSGTASSSPGSSTPSGATGSPGSST<br>PSGATGSPGSSTPSGATGSPGSSPSASTGTGPGASPGTSSTGSPGASPGTSSTGSPGTPGS<br>GTASSSPGASPGTSSTGSPGASPGTSSTGSPGASPGTSSTGSPGASPGTSSTGSPGTPGSG<br>TASSSPGSSTPSGATGSPGTPGSGTASSSPGSSTPSGATGSPGTPGSGTASSSPGSSTPSG<br>ATGSPGSSTPSGATGSPGSSPSASTGTGPGSSPSASTGTGPGSSPGTPGSGT<br>ASSSPGSSTPSGATGSPGSSPSASTGTGPGSSPSASTGTGPGASPGTSSTGSPGASPGTSS<br>TGSPGSSTPSGATGSPGSSPSASTGTGPGASPGTSSTGSPGSSPSASTGTGPGTPGSGTAS<br>SSPGSSTPSGATGSPGSSTPSGATGSPGASPGTSSTGSPTAEAAGCGTAEAAR | 306 |
| Seg 115 | AEATTAAGGAEEETAEAAGCGTAEAAGASPGTSSTGSPGSSPSASTGTGPGSSPSASTG<br>TGPGTPGSGTASSSPGSSTPSGATGSPGSSPSASTGTGPGASPGTSSTGSPGTPGSGTASS<br>SPGSSTPSGATGSPGTPGSGTASSSPGASPGTSSTGSPGASPGTSSTGSPGTPGSGTASSS<br>PGSSTPSGATGSPGASPGTSSTGSPGTPGSGTASSSPGSSTPSGATGSPGSSPSASTGTGP<br>GSSPSASTGTGPGSSTPSGATGSPGSSTPSGATGSPGASPGTSSTGSPGASPGTSSTGSPG<br>ASPGTSSTGSPGTPGSGTASSSPGASPGTSSTGSPGASPGTSSTGSPGASPGTSSTGSPGS<br>SPSASTGTGPGTPGSGTASSSPGASPGTSSTGSPGASPGTSSTGSPGASPGTSSTGSPGSS<br>TPSGATGSPGSSTPSGATGSPGASPGTSSTGSPTAEAAGCGTAEAAGTPGSGTASSSPG<br>SSTPSGATGSPGSSTPSGATGSPGSSTPSGATGSPGSSTPSGATGSPGSSPSASTGTGPGA<br>SPGTSSTGSPGTPGSGTASSSPGASPGTSSTGSPGASPGTSSTGSPGASPGTSSTGSPGAS<br>PGTSSTGSPGTPGSGTASSSPGSSTPSGATGSPGTPGSGTASSSPGSSTPSGATGSPGTPG<br>SGTASSSPGSSTPSGATGSPGSSTPSGATGSPGSSPSASTGTGPGSSPSASTGTGPGASPG<br>TSSTGSPGTPGSGTASSSPGSSTPSGATGSPGSSPSASTGTGPGASPGTSSTGSPGSSPAS<br>SSTGSPGASPGTSSTGSPGSSTPSGATGSPGSSPSASTGTGPGASPGTSSTGSPGSSPSAS<br>TGTGPGTPGSGTASSSPGSSTPSGATGSPGSSTPSGATGSPGASPGTSSTGSPTAEAAGC<br>GTAEAAR | 307 |
| Seg 116 | AEATTAAGGAEEETAEAAGCGTAEAAGASPGTSSTGSPGSSPSASTGTGPGSSPSASTG<br>TGPGTPGSGTASSSPGSSTPSGATGSPGSSPSASTGTGPGASPGTSSTGSPGTPGSGTASS<br>SPGSSTPSGATGSPGTPGSGTASSSPGASPGTSSTGSPGASPGTSSTGSPGTPGSGTASSS<br>PGSSTPSGATGSPGASPGTSSTGSPGTPGSGTASSSPGSSTPSGATGSPGSSPSASTGTGP<br>GSSPSASTGTGPGSSTPSGATGSPGSSTPSGATGSPGASPGTSSTGSPGASPGTSSTGSPG | 308 |

TABLE 3-continued

Cysteine- and lysine-engineered XTEN

| Name | Amino Acid Sequence | SEQ ID NO: |
|---|---|---|
| | ASPGTSSTGSPTAEAAGCGTAEAAGTPGSGTASSSPGASPGTSSTGSPGASPGTSSTGSP<br>GASPGTSSTGPGSSPSASTGTGPGTPGSGTASSSPGASPGTSSTGSPGASPGTSSTGSPG<br>ASPGTSSTGSPGSSTPSGATGSPGSSTPSGATGSPGASPGTSSTGSPGTPGSGTASSSPGS<br>STPSGATGSPGSSTPSGATGSPGSSTPSGATGSPGSSPSASTGTGPGASPGTSSTGSPGAS<br>PGTSSTGSPGTPGSGTASSSPGASPGTSSTGSPGASPGTSSTGSPGASPGTSSTGSPGASP<br>GTSSTGSPTAEAAGCGTAEAAGTPGSGTASSSPGSSTPSGATGSPGTPGSGTASSSPGSS<br>TPSGATGSPGTPGSGTASSSPGSSTPSGATGSPGSSTPSGATGSPGSSPSASTGTGPGSSP<br>SASTGTGPGASPGTSSTGSPGTPGSGTASSSPGSSTPSGATGSPGSSPSASTGTGPGSSPS<br>ASTGTGPGASPGTSSTGSPGASPGTSSTPSGSSTPSGATGSPGSSPSASTGTGPGASPG<br>TSSTGSPGSSPSASTGTGPGTPGSGTASSSPGSSTPSGATGSPGSSTPSGATGSPGASPGT<br>SSTGSPTAEAAGCGTAEAAR | |
| Seq 117 | ATGTATSEGSPEEEEGASPGTSSTGSPGSSPSASTGTGPGSSPSASTGTGPGTPGSGTAS<br>SSPGSSTPSGATGSPGSSPSASTGTGPGASPGTSSTGSPGTPGSGTASSSPGSSTPSGATG<br>SPGTPGSGTASSSPGASPGTSSTGSPGASPGTSSTGSPGTPGSGTASSSPGSSTPSGATGS<br>PGASPGTSSTGSPGTPGSGTASSSPGSSTPSGATGSPGSSPSASTGTGPGSSPSASTGTGP<br>GSSTPSGATGSPGSSTPSGATGSPGASPGTSSTGSPGASPGTSSTGSPGASPGTSSTGSPG<br>TPGSGTASSSPGASPGTSSTGSPGASPGTSSTGSPGASPGTSSTGSPGSSPSASTGTGPGT<br>PGSGTASSSPGASPGTSSTGSPGASPGTSSTGSPGASPGTSSTGSPGSSTPSGATGSPGSS<br>TPSGATGSPGASPGTSSTGSPTAEAAGCGTAEAAGTPGSGTASSSPGSSTPSGATGSPG<br>SSTPSGATGSPGSSTPSGATGSPGSSPSASTGTGPGASPGTSSTGSPGASPGTSSTGSPGT<br>PGSGTASSSPGASPGTSSTGSPGASPGTSSTGSPGASPGTSSTGSPGASPGTSSTGSPGTP<br>GSGTASSSPGSSTPSGATGSPGTPGSGTASSSPGSSTPSGATGSPGTPGSGTASSSPGSST<br>PSGATGSPGSSTPSGATGSPGSSPSASTGTGPGSSPSASTGTGPGASPGTSSTGSPGTPGS<br>GTASSSPGSSTPSGATGSPGSSPSASTGTGPGSSPSASTGTGPGASPGTSSTGSPGASPGT<br>SSTGSPGSSTPSGATGSPGSSPSASTGTGPGASPGTSSTGSPGSSPSASTGTGPGTPGSGT<br>ASSSPGSSTPSGATGSPGSSTPSGATGSPGASPGTSSTGSPR | 309 |
| Seq 118 | ATGTATSEGSPEEEETAEAAGCGTAEAAGASPGTSSTGSPGSSPSASTGTGPGSSPSAST<br>GTGPGTPGSGTASSSPGSSTPSGATGSPGSSPSASTGTGPGASPGTSSTGSPGTPGSGTA<br>SSSPGSSTPSGATGSPGTPGSGTASSSPGASPGTSSTGSPGASPGTSSTGSPGTPGSGTAS<br>SSPGSSTPSGATGSPGASPGTSSTGSPGTPGSGTASSSPGSSTPSGATGSPGSSPSASTGT<br>GPGSSPSASTGTGPGSSTPSGATGSPGSSTPSGATGSPGASPGTSSTGSPGASPGTSSTGS<br>PGASPGTSSTGSPGTPGSGTASSSPGASPGTSSTGSPGASPGTSSTGSPGASPGTSSTGSPG<br>GSSPSASTGTGPGTPGSGTASSSPGASPGTSSTGSPGASPGTSSTGSPGASPGTSSTGSPG<br>SSTPSGATGSPGSSTPSGATGSPGASPGTSSTGSPGTPGSGTASSSPGSSTPSGATGSPGS<br>STPSGATGSPGSSTPSGATGSPGSSPSASTGTGPGASPGTSSTGSPGASPGTSSTGSPGTP<br>GSGTASSSPGASPGTSSTGSPGASPGTSSTGSPGASPGTSSTGSPGASPGTSSTGSPGTPG<br>SGTASSSPGSSTPSGATGSPGTPGSGTASSSPGSSTPSGATGSPGTPGSGTASSSPGSSTP<br>SGATGSPGSSTPSGATGSPGSSPSASTGTGPGSSPSASTGTGPGASPGTSSTGSPGTPGS<br>GTASSSPGSSTPSGATGSPGSSPSASTGTGPGSSPSASTGTGPGASPGTSSTGSPGASPGT<br>SSTGSPGSSTPSGATGSPGSSPSASTGTGPGASPGTSSTGSPGSSPSASTGTGPGTPGSGT<br>ASSSPGSSTPSGATGSPGSSTPSGATGSPGASPGTSSTGSPTAEAAGCGTAEAAR | 310 |
| Seq 119 | ATGTATSEGSPEEEETAEAAGCGTAEAAGASPGTSSTGSPGSSPSASTGTGPGSSPSAST<br>GTGPGTPGSGTASSSPGSSTPSGATGSPGSSPSASTGTGPGASPGTSSTGSPGTPGSGTA<br>SSSPGSSTPSGATGSPGTPGSGTASSSPGASPGTSSTGSPGASPGTSSTGSPGTPGSGTAS<br>SSPGSSTPSGATGSPGASPGTSSTGSPGTPGSGTASSSPGSSTPSGATGSPGSSPSASTGT<br>GPGSSPSASTGTGPGSSTPSGATGSPGSSTPSGATGSPGASPGTSSTGSPGASPGTSSTGS<br>PGASPGTSSTGSPGTPGSGTASSSPGASPGTSSTGSPGASPGTSSTGSPGASPGTSSTGSP<br>GSSPSASTGTGPGTPGSGTASSSPGASPGTSSTGSPGASPGTSSTGSPGASPGTSSTGSPG<br>SSTPSGATGSPGSSTPSGATGSPGASPGTSSTGSPTAEAAGCGTAEAAGTPGSGTASSSP<br>GSSTPSGATGSPGSSTPSGATGSPGSSPSASTGTGPGASPGTSSTGSPG<br>ASPGTSSTGSPGTPGSGTASSSPGASPGTSSTGSPGASPGTSSTGSPGASPGTSSTGSPGA<br>SPGTSSTGSPGTPGSGTASSSPGSSTPSGATGSPGTPGSGTASSSPGSSTPSGATGSPGTP<br>GSGTASSSPGSSTPSGATGSPGSSTPSGATGSPGSSPSASTGTGPGSSPSASTGTGPGASP<br>GTSSTGSPGTPGSGTASSSPGSSTPSGATGSPGSSPSASTGTGPGSSPSASTGTGPGASPG<br>TSSTGSPGASPGTSSTGSPGSSTPSGATGSPGSSPSASTGTGPGASPGTSSTGSPGSSPSA<br>STGTGPGTPGSGTASSSPGSSTPSGATGSPGSSTPSGATGSPGASPGTSSTGSPTAEAAG<br>CGTAEAAR | 311 |
| Seq 120 | ATGTATSEGSPEEEETAEAAGCGTAEAAGASPGTSSTGSPGSSPSASTGTGPGSSPSAST<br>GTGPGTPGSGTASSSPGSSTPSGATGSPGSSPSASTGTGPGASPGTSSTGSPGTPGSGTA<br>SSSPGSSTPSGATGSPGASPGTSSTGSPGTPGSGTASSSPGSSTPSGATGSPGSSPSASTGT<br>GPGSSPSASTGTGPGSSTPSGATGSPGSSTPSGATGSPGASPGTSSTGSPGASPGTSSTGS<br>PGASPGTSSTGSPTAEAAGCGTAEAAGTPGSGTASSSPGASPGTSSTGSPGASPGTSST<br>GSPGASPGTSSTGSPGASPGTSSTGSPGSSPSASTGTGPGTPGSGTASSSPGASPGTSSTG<br>SPGASPGTSSTGSPGSSTPSGATGSPGSSTPSGATGSPGASPGTSSTGSPGTPGSGTASSS<br>PGSSTPSGATGSPGSSTPSGATGSPGSSTPSGATGSPGSSPSASTGTGPGASPGTSSTGSP<br>GASPGTSSTGSPGTPGSGTASSSPGASPGTSSTGSPGASPGTSSTGSPGASPGTSSTGSPG<br>ASPGTSSTGSPTAEAAGCGTAEAAGTPGSGTASSSPGSSTPSGATGSPGTPGSGTASSSP<br>GSSTPSGATGSPGTPGSGTASSSPGSSTPSGATGSPGSSTPSGATGSPGSSPSASTGTGPG<br>SSPSASTGTGPGASPGTSSTGSPGTPGSGTASSSPGSSTPSGATGSPGSSPSASTGTGPGS | 312 |

TABLE 3-continued

Cysteine- and lysine-engineered XTEN

| Name | Amino Acid Sequence | SEQ ID NO: |
|---|---|---|
| | SPSASTGTGPGASPGTSSTGSPGASPGTSSTGSPGSSTPSGATGSPGSSSPSASTGTGPGAS<br>PGTSSTGSPGSSPSASTGTGPGTPGSGTASSSPGSSTPSGATGSPGSSTPSGATGSPGASP<br>GTSSTGSPTAEAAGCGTAEAAR | |
| Seg 121 | AEATTAAGGAEEEGASPGTSSTGSPGSSPSASTGTGPGSSPSASTGTGPGTPGSGTASSS<br>PGSSTPSGATGSPGSSPSASTGTGPGASPGTSSTGSPGTPGSGTASSSPGSSTPSGATGSP<br>GTPGSGTASSSPGASPGTSSTGSPGASPGTSSTGSPGTPGSGTASSSPGSSTPSGATGSPG<br>ASPGTSSTGSPGTPGSGTASSSPGSSTPSGATGSPGSSPSASTGTGPGSSPSASTGTGPGS<br>STPSGATGSPGSSTPSGATGSPGASPGTSSTGSPGASPGTSSTGSPGTP<br>GSGTASSSPGASPGTSSTGSPGASPGTSSTGSPGASPGTSSTGSPGSSPSASTGTGPGTPG<br>SGTASSSPGASPGTSSTGSPGASPGTSSTGSPGASPGTSSTGSPGSSTPSGATGSPGSSTP<br>SGATGSPGASPGTSSTGSPTAEAAGCGTAEAAGTPGSGTASSSPGSSTPSGATGSPGSS<br>TPSGATGSPGSSTPSGATGSPGSSPSASTGTGPGASPGTSSTGSPGASPGTSSTGSPGTPG<br>SGTASSSPGASPGTSSTGSPGASPGTSSTGSPGASPGTSSTGSPGASPGTSSTGSPGTPGS<br>GTASSSPGSSTPSGATGSPGTPGSGTASSSPGSSTPSGATGSPGTPGSGTASSSPGSSTPS<br>GATGSPGSSTPSGATGSPGSSPSASTGTGPGSSPSASTGTGPGASPGTSSTGSPGTPGSG<br>TASSSPGSSTPSGATGSPGSSPSASTGTGPGSSPSASTGTGPGASPGTSSTGSPGASPGTS<br>STGSPGSSTPSGATGSPGSSPSASTGTGPGASPGTSSTGSPGSSPSASTGTGPGTPGSGTA<br>SSSPGSSTPSGATGSPGSSTPSGATGSPGASPGTSSTGSPRPRPRPRP | 313 |
| Seg 122 | AEATTAAGGAEEETAEAAGCGTAEAAGASPGTSSTGSPGSSPSASTGTGPGSSPSASTG<br>TGPGTPGSGTASSSPGSSTPSGATGSPGSSPSASTGTGPGASPGTSSTGSPGTPGSGTASS<br>SPGSSTPSGATGSPGTPGSGTASSSPGASPGTSSTGSPGASPGTSSTGSPGTPGSGTASSS<br>PGSSTPSGATGSPGASPGTSSTGSPGTPGSGTASSSPGSSTPSGATGSPGSSPSASTGTGP<br>GSSPSASTGTGPGSSTPSGATGSPGSSTPSGATGSPGASPGTSSTGSPGASPGTSSTGPGS<br>ASPGTSSTGSPGTPGSGTASSSPGASPGTSSTGSPGASPGTSSTGSPGASPGTSSTGSPGS<br>SPSASTGTGPGTPGSGTASSSPGASPGTSSTGSPGASPGTSSTGSPGASPGTSSTGSPGSS<br>TPSGATGSPGSSTPSGATGSPGASPGTSSTGSPGTPGSGTASSSPGSSTPSGATGSPGSST<br>PSGATGSPGSSTPSGATGSPGSSPSASTGTGPGASPGTSSTGSPGASPGTSSTGSPGTPGS<br>GTASSSPGASPGTSSTGSPGASPGTSSTGSPGASPGTSSTGSPGASPGTSSTGSPGTPGSG<br>TASSSPGSSTPSGATGSPGTPGSGTASSSPGSSTPSGATGSPGTPGSGTASSSPGSSTPSG<br>ATGSPGSSTPSGATGSPGSSPSASTGTGPGSSPSASTGTGPGASPGTSSTGSPGTPGSGT<br>ASSSPGSSTPSGATGSPGSSPSASTGTGPGSSPSASTGTGPGASPGTSSTGSPGASPGTSS<br>TGSPGSSTPSGATGSPGSSPSASTGTGPGASPGTSSTGSPGSSPSASTGTGPGTPGSGTAS<br>SSPGSSTPSGATGSPGSSTPSGATGSPGASPGTSSTGSPTAEAAGCGTAEAARPRPRPRP | 314 |
| Seg 123 | AEATTAAGGAEEETAEAAGCGTAEAAGASPGTSSTGSPGSSPSASTGTGPGSSPSASTG<br>TGPGTPGSGTASSSPGSSTPSGATGSPGSSPSASTGTGPGASPGTSSTGSPGTPGSGTASS<br>SPGSSTPSGATGSPGTPGSGTASSSPGASPGTSSTGSPGASPGTSSTGSPGTPGSGTASSS<br>PGSSTPSGATGSPGASPGTSSTGSPGTPGSGTASSSPGSSTPSGATGSPGSSPSASTGTGP<br>GSSPSASTGTGPGSSTPSGATGSPGSSTPSGATGSPGASPGTSSTGSPGASPGTSSTGSPG<br>ASPGTSSTGSPGTPGSGTASSSPGASPGTSSTGSPGASPGTSSTGSPGASPGTSSTGSPGSS<br>SPSASTGTGPGTPGSGTASSSPGASPGTSSTGSPGASPGTSSTGSPGASPGTSSTGSPGSS<br>TPSGATGSPGSSTPSGATGSPGASPGTSSTGSPTAEAAGCGTAEAAGTPGSGTASSSPG<br>SSTPSGATGSPGSSTPSGATGSPGSSTPSGATGSPGSSPSASTGTGPGASPGTSSTGSPGA<br>SPGTSSTGSPGTPGSGTASSSPGASPGTSSTGSPGASPGTSSTGSPGASPGTSSTGSPGAS<br>PGTSSTGSPGTPGSGTASSSPGSSTPSGATGSPGTPGSGTASSSPGSSTPSGATGSPGTPG<br>SGTASSSPGSSTPSGATGSPGSSTPSGATGSPGSSPSASTGTGPGSSPSASTGTGPGASPG<br>TSSTGSPGTPGSGTASSSPGSSTPSGATGSPGSSPSASTGTGPGSSPSASTGTGPGASPGT<br>SSTGSPGASPGTSSTGSPGSSTPSGATGSPGSSPSASTGTGPGASPGTSSTGSPGSSPSAS<br>TGTGPGTPGSGTASSSPGSSTPSGATGSPGSSTPSGATGSPGASPGTSSTGSPTAEAAGC<br>GTAEAARPRPRPRP | 315 |
| Seg 124 | AEATTAAGGAEEETAEAAGCGTAEAAGASPGTSSTGSPGSSPSASTGTGPGSSPSASTG<br>TGPGTPGSGTASSSPGSSTPSGATGSPGSSPSASTGTGPGASPGTSSTGSPGTPGSGTASS<br>SPGSSTPSGATGSPGTPGSGTASSSPGASPGTSSTGSPGASPGTSSTGSPGTPGSGTASSS<br>PGSSTPSGATGSPGASPGTSSTGSPGTPGSGTASSSPGSSTPSGATGSPGSSPSASTGTGP<br>GSSPSASTGTGPGSSTPSGATGSPGSSTPSGATGSPGASPGTSSTGSPGASPGTSSTGSPG<br>ASPGTSSTGSPTAEAAGCGTAEAAGTPGSGTASSSPGASPGTSSTGSPGASPGTSSTGSP<br>GASPGTSSTGSPGSSPSASTGTGPGTPGSGTASSSPGASPGTSSTGSPGASPGTSSTGSPG<br>ASPGTSSTGSPGSSTPSGATGSPGSSTPSGATGSPGASPGTSSTGSPGTPGSGTASSSPGS<br>STPSGATGSPGSSTPSGATGSPGSSTPSGATGSPGSSPSASTGTGPGASPGTSSTGSPGAS<br>PGTSSTGSPGTPGSGTASSSPGASPGTSSTGSPGASPGTSSTGSPGASPGTSSTGSPGASP<br>GTSSTGSPTAEAAGCGTAEAAGTPGSGTASSSPGSSTPSGATGSPGTPGSGTASSSPGSS<br>TPSGATGSPGTPGSGTASSSPGSSTPSGATGSPGSSTPSGATGSPGSSPSASTGTGPGSSP<br>SASTGTGPGASPGTSSTGSPGTPGSGTASSSPGSSTPSGATGSPGSSPSASTGTGPGSSPS<br>ASTGTGPGASPGTSSTGSPGASPGTSSTGSPGSSTPSGATGSPGSSPSASTGTGPGASPG<br>TSSTGSPGSSPSASTGTGPGTPGSGTASSSPGSSTPSGATGSPGSSTPSGATGSPGASPGT<br>SSTGSPTAEAAGCGTAEAARPRPRPRP | 316 |
| Seg 125 | AEATTAAGGAEEEGASPGTSSTGSPGSSPSASTGTGPGSSPSASTGTGPGTPGSGTASSS<br>PGSSTPSGATGSPGSSPSASTGTGPGASPGTSSTGSPGTPGSGTASSSPGSSTPSGATGSP<br>GTPGSGTASSSPGASPGTSSTGSPGASPGTSSTGSPGTPGSGTASSSPGSSTPSGATGSPG<br>ASPGTSSTGSPGTPGSGTASSSPGSSTPSGATGSPGSSPSASTGTGPGSSPSASTGTGPGS<br>STPSGATGSPGSSTPSGATGSPGASPGTSSTGSPGASPGTSSTGSPGASPGTSSTGSPGTP<br>GSGTASSSPGASPGTSSTGSPGASPGTSSTGSPGASPGTSSTGSPGSSPSASTGTGPGTPG | 317 |

TABLE 3-continued

Cysteine- and lysine-engineered XTEN

| Name | Amino Acid Sequence | SEQ ID NO: |
|---|---|---|
| | SGTASSSPGASPGTSSTGSPGASPGTSSTGSPGASPGTSSTGSPGSSTPSGATGSPGSSTP SGATGSPGASPGTSSTGSPTAEAAGCGTAEAAGTPGSGTASSSPGSSTPSGATGSPGSS TPSGATGSPGSSTPSGATGSPGSSPSASTGTGPGASPGTSSTGSPGASPGTSSTGSPTPG SGTASSSPGASPGTSSTGSPGASPGTSSTGSPGASPGTSSTGSPGASPGTSSTGSPTPGS GTASSSPGSSTPSGATGSPGPTPGSGTASSSPGSSTPSGATGSPGTPGSGTASSSPGSSTPS GATGSPGSSTPSGATGSPGSSPSASTGTGPGSSPSASTGTGPGASPGTSSTGSPGTPGSG TASSSPGSSTPSGATGSPGSSPSASTGTGPGSSPSASTGTGPGASPGTSSTGSPGASPGTS STGSPGSSTPSGATGSPGSSPSASTGTGPGASPGTSSTGSPGSSPSASTGTGPGTPGSGTA SSSPGSSTPSGATGSPGSSTPSGATGSPGASPGTSSTGSPR | |
| Seg 126 | AEATTAAGGAEEETAEAAGCGTAEAAGASPGTSSTGSPGSSPSASTGTGPGSSPSASTG TGPGTPGSGTASSSPGSSTPSGATGSPGSSPSASTGTGPGASPGTSSTGSPGTPGSGTASS SPGSSTPSGATGSPGTPGSGTASSSPGASPGTSSTGSPGASPGTSSTGSPGTPGSGTASSS PGSSTPSGATGSPGASPGTSSTGSPGTPGSGTASSSPGSSTPSGATGSPGSSPSASTGTGP GSSPSASTGTGPGSSTPSGATGSPGSSTPSGATGSPGASPGTSSTGSPGASPGTSSTGSPG ASPGTSSTGSPGTPGSGTASSSPGASPGTSSTGSPGASPGTSSTGSPGASPGTSSTGSPGS SPSASTGTGPGTPGSGTASSSPGASPGTSSTGSPGASPGTSSTGSPGASPGTSSTGSPGSS TPSGATGSPGSSTPSGATGSPGASPGTSSTGSPGTPGSGTASSSPGSSTPSGATGSPGSST PSGATGSPGSSTPSGATGSPGSSPSASTGTGPGASPGTSSTGSPGASPGTSSTGSPGTPGS GTASSSPGASPGTSSTGSPGASPGTSSTGSPGASPGTSSTGSPGASPGTSSTGSPGTPGSG TASSSPGSSTPSGATGSPGTPGSGTASSSPGSSTPSGATGSPGTPGSGTASSSPGSSTPSG ATGSPGSSTPSGATGSPGSSPSASTGTGPGSSPSASTGTGPGASPGTSSTGSPGTPGSGT ASSSPGSSTPSGATGSPGSSPSASTGTGPGSSPSASTGTGPGASPGTSSTGSPGASPGTSS TGSPGSSTPSGATGSPGSSPSASTGTGPGASPGTSSTGSPGSSPSASTGTGPGTPGSGTAS SSPGSSTPSGATGSPGSSTPSGATGSPGASPGTSSTGSPTAEAAGCGTAEAAR | 318 |
| Seg 127 | AEATTAAGGAEEETAEAAGCGTAEAAGASPGTSSTGSPGSSPSASTGTGPGSSPSASTG TGPGTPGSGTASSSPGSSTPSGATGSPGSSPSASTGTGPGASPGTSSTGSPGTPGSGTASS SPGSSTPSGATGSPGTPGSGTASSSPGASPGTSSTGSPGASPGTSSTGSPGTPGSGTASSS PGSSTPSGATGSPGASPGTSSTGSPGTPGSGTASSSPGSSTPSGATGSPGSSPSASTGTGP GSSPSASTGTGPGSSTPSGATGSPGSSTPSGATGSPGASPGTSSTGSPGASPGTSSTGSPG ASPGTSSTGSPGTPGSGTASSSPGASPGTSSTGSPGASPGTSSTGSPGASPGTSSTGSPGS SPSASTGTGPGTPGSGTASSSPGASPGTSSTGSPGASPGTSSTGSPGASPGTSSTGSPGSS TPSGATGSPGSSTPSGATGSPGASPGTSSTGSPTAEAAGCGTAEAAGTPGSGTASSSPG SSTPSGATGSPGSSTPSGATGSPGSSTPSGATGSPGSSPSASTGTGPGASPGTSSTGSPGA SPGTSSTGSPGTPGSGTASSSPGASPGTSSTGSPGASPGTSSTGSPGASPGTSSTGSPGAS PGTSSTGSPGTPGSGTASSSPGSSTPSGATGSPGTPGSGTASSSPGSSTPSGATGSPGTPG SGTASSSPGSSTPSGATGSPGSSTPSGATGSPGASPGTSSTGSPGSSPSASTGTGPGASPGT SSTGSPGASPGTSSTGSPGSSTPSGATGSPGSSPSASTGTGPGASPGTSSTGSPGSSPSAS TGTGPGTPGSGTASSSPGSSTPSGATGSPGSSTPSGATGSPGASPGTSSTGSPTAEAAGC GTAEAAR | 319 |
| Seg 128 | AEATTAAGGAEEETAEAAGCGTAEAAGASPGTSSTGSPGSSPSASTGTGPGSSPSASTG TGPGTPGSGTASSSPGSSTPSGATGSPGSSPSASTGTGPGASPGTSSTGSPGTPGSGTASS SPGSSTPSGATGSPGTPGSGTASSSPGASPGTSSTGSPGASPGTSSTGSPGTPGSGTASSS PGSSTPSGATGSPGASPGTSSTGSPGTPGSGTASSSPGSSTPSGATGSPGSSPSASTGTGP GSSPSASTGTGPGSSTPSGATGSPGSSTPSGATGSPGASPGTSSTGSPGASPGTSSTGSPG ASPGTSSTGSPTAEAAGCGTAEAAGTPGSGTASSSPGASPGTSSTGSPGASPGTSSTGSP GASPGTSSTGSPGSSPSASTGTGPGTPGSGTASSSPGASPGTSSTGSPGASPGTSSTGSPG ASPGTSSTGSPGSSTPSGATGSPGSSTPSGATGSPGASPGTSSTGSPGTPGSGTASSSPGS STPSGATGSPGSSTPSGATGSPGSSTPSGATGSPGSSPSASTGTGPGASPGTSSTGSPGAS PGTSSTGSPGTPGSGTASSSPGASPGTSSTGSPGASPGTSSTGSPGASPGTSSTGSPGASP GTSSTGSPTAEAAGCGTAEAAGTPGSGTASSSPGSSTPSGATGSPGTPGSGTASSSPGSS TPSGATGSPGTPGSGTASSSPGSSTPSGATGSPGSSTPSGATGSPGSSPSASTGTGPGSSP SASTGTGPGASPGTSSTGSPGTPGSGTASSSPGSSTPSGATGSPGSSPSASTGTGPGSSPS ASTGTGPGASPGTSSTGSPGASPGTSSTGSPGSSTPSGATGSPGSSPSASTGTGPGASPG TSSTGSPGSSPSASTGTGPGTPGSGTASSSPGSSTPSGATGSPGSSTPSGATGSPGASPGT SSTGSPTAEAAGCGTAEAAR | 320 |
| Seg 129 | AEATTAAGGAEEETAEAAGCGTAEAAGASPGTSSTGSPGSSPSASTGTGPGSSPSASTG TGPGTPGSGTASSSPGSSTPSGATGSPGSSPSASTGTGPGASPGTSSTGSPGTPGSGTASS SPGSSTPSGATGSPGTPGSGTASSSPGASPGTSSTGSPGASPGTSSTGSPGTPGSGTASSS PGSSTPSGATGSPGASPGTSSTGSPGTPGSGTASSSPGSSTPSGATGSPGSSPSASTGTGP GSSPSASTGTGPGSSTPSGATGSPGSSTPSGATGSPGASPGTSSTGSPGASPGTSSTGSPG ASPGTSSTGSPGGKPGGTPGSGTASSSPGASPGTSSTGSPGASPGTSSTGSPGASPGTSS TGSPGSSPSASTGTGPGTPGSGTASSSPGASPGTSSTGSPGASPGTSSTGSPGASPGTSST GSPGSSTPSGATGSPGSSTPSGATGSPGASPGTSSTGSPGTPGSGTASSSPGSSTPSGATG SPGSSTPSGATGSPGSSTPSGATGSPGSSPSASTGTGPGASPGTSSTGSPGASPGTSSTGS PGTPGSGTASSSPGASPGTSSTGSPGASPGTSSTGSPGASPGTSSTGSPGASPGTSSTGSP TAEAAGCGTAEAAGTPGSGTASSSPGSSTPSGATGSPGTPGSGTASSSPGSSTPSGATG SPGTPGSGTASSSPGSSTPSGATGSPGSSTPSGATGSPGSSPSASTGTGPGSSPSASTGTG PGASPGTSSTGSPGTPGSGTASSSPGSSTPSGATGSPGSSPSASTGTGPGSSPSASTGTGP GASPGTSSTGSPGASPGTSSTGSPGSSTPSGATGSPGSSPSASTGTGPGASPGTSSTGSPG SSPSASTGTGPGTPGSGTASSSPGSSTPSGATGSPGSSTPSGATGSPGASPGTSSTGSPGG KPGR | 321 |

TABLE 3-continued

Cysteine- and lysine-engineered XTEN

| Name | Amino Acid Sequence | SEQ ID NO: |
| --- | --- | --- |
| Seg 130 | AEATTAAGGAEEETAEAAGCGTAEAAGASPGTSSTGSPGSSPSASTGTGPGSSPSASTG<br>TGPGTPGSGTASSSPGSSTPSGATGSPGSSPSASTGTGPGASPGTSSTGSPGTPGSGTASS<br>SPGSSTPSGATGSPGTPGSGTASSSPGASPGTSSTGSPGASPGTSSTGSPGTPGSGTASSS<br>PGSSTPSGATGSPGASPGTSSTGSPGTPGSGTASSSPGSSTPSGATGSPGSSPSASTGTGP<br>GSSPSASTGTGPGSSTPSGATGSPGSSTPSGATGSPGASPGTSSTGSPGASPGTSSTGSPG<br>ASPGTSSTGSPTAEAAGCGTAEAAGTPGSGTASSSPGASPGTSSTGSPGASPGTSSTGSP<br>GASPGTSSTGSPGSSPSASTGTGPGTPGSGTASSSPGASPGTSSTGSPGASPGTSSTGSPG<br>ASPGTSSTGSPGSSTPSGATGSPGSSTPSGATGSPGASPGTSSTGSPGTPGSGTASSSPGS<br>STPSGATGSPGSSTPSGATGSPGSSPSASTGTGPGASPGTSSTGSPGAS<br>PGTSSTGSPGTPGSGTASSSPGASPGTSSTGSPGASPGTSSTGSPGASPGTSSTGSPGASP<br>GTSSTGSPTAEAAGCGTAEAAGTPGSGTASSSPGSSTPSGATGSPGTPGSGTASSSPGSS<br>TPSGATGSPGTPGSGTASSSPGSSTPSGATGSPGSSTPSGATGSPGSSPSASTGTGPGSSP<br>SASTGTGPGASPGTSSTGSPGTPGSGTASSSPGSSTPSGATGSPGSSPSASTGTGPGSSPS<br>ASTGTGPGASPGTSSTGSPGASPGTSSTGSPGSSTPSGATGSPGSSPSASTGTGPGASPG<br>TSSTGSPGSSPSASTGTGPGTPGSGTASSSPGSSTPSGATGSPGSSTPSGATGSPGASPGT<br>SSTGSPGGKPGR | 322 |
| Seg 131 | AEATTAAGGAEEEGGKPGGASPGTSSTGSPGSSPSASTGTGPGSSPSASTGTGPGTPGS<br>GTASSSPGSSTPSGATGSPGSSPSASTGTGPGASPGTSSTGSPGTPGSGTASSSPGSSTPS<br>GATGSPGTPGSGTASSSPGASPGTSSTGSPGASPGTSSTGSPGTPGSGTASSSPGSSTPSG<br>ATGSPGASPGTSSTGSPGTPGSGTASSSPGSSTPSGATGSPGSSPSASTGTGPGSSPSAST<br>GTGPGSSTPSGATGSPGSSTPSGATGSPGASPGTSSTGSPGASPGTSSTGSPGASPGTSST<br>GSPGGKPGGTPGSGTASSSPGASPGTSSTGSPGASPGTSSTGSPGASPGTSSTGSPGSSPS<br>ASTGTGPGTPGSGTASSSPGASPGTSSTGSPGASPGTSSTGSPGASPGTSSTGSPGSSTPS<br>GATGSPGSSTPSGATGSPGASPGTSSTGSPGTPGSGTASSSPGSSTPSGATGSPGSSTPSG<br>ATGSPGSSTPSGATGSPGSSPSASTGTGPGASPGTSSTGSPGASPGTSSTGSPGTPGSGT<br>ASSSPGASPGTSSTGSPGASPGTSSTGSPGASPGTSSTGSPGASPGTSSTGSPGGKPGGTP<br>GSGTASSSPGSSTPSGATGSPGTPGSGTASSSPGSSTPSGATGSPGTPGSGTASSSPGSST<br>PSGATGSPGSSTPSGATGSPGSSPSASTGTGPGSSPSASTGTGPGASPGTSSTGSPGTPGS<br>GTASSSPGSSTPSGATGSPGSSPSASTGTGPGSSPSASTGTGPGASPGTSSTGSPGASPGT<br>SSTGSPGSSTPSGATGSPGSSPSASTGTGPGASPGTSSTGSPGSSPSASTGTGPGTPGSGT<br>ASSSPGSSTPSGATGSPGSSTPSGATGSPGASPGTSSTGSPTAEAAGCGTAEAAR | 323 |
| Seg 132 | AEATTAAGGAEEETAEAAGCGTAEAAGASPGTSSTGSPGSSPSASTGTGPGSSPSASTG<br>TGPGTPGSGTASSSPGSSTPSGATGSPGSSPSASTGTGPGASPGTSSTGSPGTPGSGTASS<br>SPGSSTPSGATGSPGTPGSGTASSSPGASPGTSSTGSPGASPGTSSTGSPGTPGSGTASSS<br>PGSSTPSGATGSPGASPGTSSTGSPGTPGSGTASSSPGSSTPSGATGSPGSSPSASTGTGP<br>GSSPSASTGTGPGSSTPSGATGSPGSSTPSGATGSPGASPGTSSTGSPGASPGTSSTGSPG<br>ASPGTSSTGSPGGKPGGTPGSGTASSSPGASPGTSSTGSPGASPGTSSTGSPGASPGTSS<br>TGSPGSSPSASTGTGPGTPGSGTASSSPGASPGTSSTGSPGASPGTSSTGSPGASPGTSST<br>GSPGSSTPSGATGSPGSSTPSGATGSPGASPGTSSTGSPGTPGSGTASSSPGSSTPSGATG<br>SPGSSTPSGATGSPGSSTPSGATGSPGSSPSASTGTGPGASPGTSSTGSPGASPGTSSTGS<br>PGTPGSGTASSSPGASPGTSSTGSPGASPGTSSTGSPGASPGTSSTGSPGASPGTSSTGSP<br>TAEAAGCGTAEAAGTPGSGTASSSPGSSTPSGATGSPGTPGSGTASSSPGSSTPSGATG<br>SPGTPGSGTASSSPGSSTPSGATGSPGSSTPSGATGSPGSSPSASTGTGPGSSPSASTGTG<br>PGASPGTSSTGSPGTPGSGTASSSPGSSTPSGATGSPGSSPSASTGTGPGSSPSASTGTGP<br>GASPGTSSTGSPGASPGTSSTGSPGSSTPSGATGSPGSSPSASTGTGPGASPGTSSTGSPG<br>SSPSASTGTGPGTPGSGTASSSPGSSTPSGATGSPGSSTPSGATGSPGASPGTSSTGSPGG<br>KPGR | 324 |
| Seg 133 | AEATTAAGGAEEEGASPGTSSTGSPGSSPSASTGTGPGSSPSASTGTGPGTPGSGTASSS<br>PGSSTPSGATGSPGSSPSASTGTGPGASPGTSSTGSPGTPGSGTASSSPGSSTPSGATGSP<br>GTPGSGTASSSPGASPGTSSTGSPGASPGTSSTGSPGTPGSGTASSSPGSSTPSGATGSPG<br>ASPGTSSTGSPGTPGSGTASSSPGSSTPSGATGSPGSSPSASTGTGPGSSPSASTGTGPGS<br>STPSGATGSPGSSTPSGATGSPGASPGTSSTGSPGASPGTSSTGSPGASPGTSSTGSPGTP<br>GSGTASSSPGASPGTSSTGSPGASPGTSSTGSPGASPGTSSTGSPGSSPSASTGTGPGTPG<br>SGTASSSPGASPGTSSTGSPGASPGTSSTGSPGASPGTSSTGSPGSSTPSGATGSPGSSTP<br>SGATGSPGASPGTSSTGSPGTPGSGTASSSPGSSTPSGATGSPGSSTPSGATGSPGSSTPS<br>GATGSPGSSPSASTGTGPGASPGTSSTGSPGASPGTSSTGSPGTPGSGTASSSPGASPGT<br>SSTGSPGASPGTSSTGSPGASPGTSSTGSPTAEAAGCGTAEAAR | 325 |
| Seg 134 | AEATTAAGGAEEEGASPGTSSTGSPGSSPSASTGTGPGSSPSASTGTGPGTPGSGTASSS<br>PGSSTPSGATGSPGSSPSASTGTGPGASPGTSSTGSPGTPGSGTASSSPGSSTPSGATGSP<br>GTPGSGTASSSPGASPGTSSTGSPGASPGTSSTGSPGTPGSGTASSSPGSSTPSGATGSPG<br>ASPGTSSTGSPGTPGSGTASSSPGSSTPSGATGSPGSSPSASTGTGPGSSPSASTGTGPGS<br>STPSGATGSPGSSTPSGATGSPGASPGTSSTGSPGASPGTSSTGSPGASPGTSSTGSPGTP<br>GSGTASSSPGASPGTSSTGSPGASPGTSSTGSPGASPGTSSTGSPGSSPSASTGTGPGTPG<br>SGTASSSPGASPGTSSTGSPGASPGTSSTGSPGASPGTSSTGSPGSSTPSGATGSPGSSTP<br>SGATGSPGASPGTSSTGSPTAEAAGCGTAEAAR | 326 |
| Seg 135 | AEATTAAGGAEEEGASPGTSSTGSPGSSPSASTGTGPGSSPSASTGTGPGTPGSGTASSS<br>PGSSTPSGATGSPGSSPSASTGTGPGASPGTSSTGSPGTPGSGTASSSPGSSTPSGATGSP<br>GTPGSGTASSSPGASPGTSSTGSPGASPGTSSTGSPGTPGSGTASSSPGSSTPSGATGSPG<br>ASPGTSSTGSPGTPGSGTASSSPGSSTPSGATGSPGSSPSASTGTGPGSSPSASTGTGPGS<br>STPSGATGSPGSSTPSGATGSPGASPGTSSTGSPGASPGTSSTGSPGASPGTSSTGSPTAE<br>AAGCGTAEAAR | 327 |

TABLE 3-continued

Cysteine- and lysine-engineered XTEN

| Name | Amino Acid Sequence | SEQ ID NO: |
|---|---|---|
| Seg 136 | AEATTAAGGAEEEGASPGTSSTGSPGSSPSASTGTGPGSSPSASTGTGPGTPGSGTASSS PGSSTPSGATGSPGSSPSASTGTGPGASPGTSSTGSPGTPGSGTASSSPGSSTPSGATGSP GTPGSGTASSSPGASPGTSSTGSPGASPGTSSTGSPTAEAAGCGTAEAAR | 328 |
| Seg 137 | AEATTAAGGAEEEGASPGTSSTGSPGSSPSASTGTGPGSSPSASTGTGPGTPGSGTASSS PGSSTPSGATGSPGSSPSASTGTGPGASPGTSSTGSPGTPGSGTASSSPGSSTPSGATGSP GTPGSGTASSSPGASPGTSSTGSPGASPGTSSTGSPGTPGSGTASSSPGSSTPSGATGSPG ASPGTSSTGSPGTPGSGTASSSPGSSTPSGATGSPGSSPSASTGTGPGSSPSASTGTGPGS STPSGATGSPGSSTPSGATGSPGASPGTSSTGSPGASPGTSSTGSPGASPGTSSTGSPGTPG GSGTASSSPGASPGTSSTGSPGASPGTSSTGSPGASPGTSSTGSPGSSPSASTGTGPGTPG SGTASSSPGASPGTSSTGSPGASPGTSSTGSPGASPGTSSTGSPGSSTPSGATGSPGSSTP SGATGSPGASPGTSSTGSPGTPGSGTASSSPGSSTPSGATGSPGSSTPSGATGSPGSSTPS GATGSPGSSPSASTGTGPGASPGTSSTGSPGASPGTSSTGSPGTPGSGTASSSPGASPGT SSTGSPGASPGTSSTGSPGASPGTSSTGSPTAEAAGCGTAEAAR | 329 |
| Seg 138 | AEATTAAGGAEEEGASPGTSSTGSPGSSPSASTGTGPGSSPSASTGTGPGTPGSGTASSS PGSSTPSGATGSPGSSPSASTGTGPGASPGTSSTGSPGTPGSGTASSSPGSSTPSGATGSP GTPGSGTASSSPGASPGTSSTGSPGASPGTSSTGSPGTPGSGTASSSPGSSTPSGATGSPG ASPGTSSTGSPGTPGSGTASSSPGSSTPSGATGSPGSSPSASTGTGPGSSPSASTGTGPGS STPSGATGSPGSSTPSGATGSPGASPGTSSTGSPGASPGTSSTGSPGASPGTSSTGSPGTP GSGTASSSPGASPGTSSTGSPGASPGTSSTGSPGASPGTSSTGSPGSSPSASTGTGPGTPG SGTASSSPGASPGTSSTGSPGASPGTSSTGSPGASPGTSSTGSPGSSTPSGATGSPGSSTP SGATGSPGASPGTSSTGSPTAEAAGCGTAEAAR | 330 |
| Seg 139 | AEATTAAGGAEEEGASPGTSSTGSPGSSPSASTGTGPGSSPSASTGTGPGTPGSGTASSS PGSSTPSGATGSPGSSPSASTGTGPGASPGTSSTGSPGTPGSGTASSSPGSSTPSGATGSP GTPGSGTASSSPGASPGTSSTGSPGASPGTSSTGSPGTPGSGTASSSPGSSTPSGATGSPG ASPGTSSTGSPGTPGSGTASSSPGSSTPSGATGSPGSSPSASTGTGPGSSPSASTGTGPGS STPSGATGSPGSSTPSGATGSPGASPGTSSTGSPGASPGTSSTGSPGASPGTSSTGSPTAE AAGCGTAEAAR | 331 |
| Seg 140 | AEATTAAGGAEEEGASPGTSSTGSPGSSPSASTGTGPGSSPSASTGTGPGTPGSGTASSS PGSSTPSGATGSPGSSPSASTGTGPGASPGTSSTGSPGTPGSGTASSSPGSSTPSGATGSP GTPGSGTASSSPGASPGTSSTGSPGASPGTSSTGSPTAEAAGCGTAEAAR | 332 |
| Seg 141 | AEATTAAGGAEEEGASPGTSSTGSPGSSPSASTGTGPGSSPSASTGTGPGTPGSGTASSS PGSSTPSGATGSPGSSPSASTGTGPGASPGTSSTGSPGTPGSGTASSSPGSSTPSGATGSP GTPGSGTASSSPGASPGTSSTGSPGASPGTSSTGSPGTPGSGTASSSPGSSTPSGATGSPG ASPGTSSTGSPGTPGSGTASSSPGSSTPSGATGSPGSSPSASTGTGPGSSPSASTGTGPGS STPSGATGSPGSSTPSGATGSPGASPGTSSTGSPGASPGTSSTGSPGASPGTSSTGSPGTP GSGTASSSPGASPGTSSTGSPGASPGTSSTGSPGASPGTSSTGSPGSSPSASTGTGPGTPG SGTASSSPGASPGTSSTGSPGASPGTSSTGSPGASPGTSSTGSPGSSTPSGATGSPGSSTP SGATGSPGASPGTSSTGSPGTPGSGTASSSPGSSTPSGATGSPGSSTPSGATGSPGSSTPS GATGSPGSSPSASTGTGPGASPGTSSTGSPGASPGTSSTGSPGTPGSGTASSSPGASPGT SSTGSPGASPGTSSTGSPGASPGTSSTGSPGGKPGR | 333 |
| Seg 142 | AEATTAAGGAEEEGASPGTSSTGSPGSSPSASTGTGPGSSPSASTGTGPGTPGSGTASSS PGSSTPSGATGSPGSSPSASTGTGPGASPGTSSTGSPGTPGSGTASSSPGSSTPSGATGSP GTPGSGTASSSPGASPGTSSTGSPGASPGTSSTGSPGTPGSGTASSSPGSSTPSGATGSPG ASPGTSSTGSPGTPGSGTASSSPGSSTPSGATGSPGSSPSASTGTGPGSSPSASTGTGPGS STPSGATGSPGSSTPSGATGSPGASPGTSSTGSPGASPGTSSTGSPGASPGTSSTGSPGTP GSGTASSSPGASPGTSSTGSPGASPGTSSTGSPGASPGTSSTGSPGSSPSASTGTGPGTPG SGTASSSPGASPGTSSTGSPGASPGTSSTGSPGASPGTSSTGSPGSSTPSGATGSPGSSTP SGATGSPGASPGTSSTGSPGGKPGR | 334 |
| Seg 143 | AEATTAAGGAEEEGASPGTSSTGSPGSSPSASTGTGPGSSPSASTGTGPGTPGSGTASSS PGSSTPSGATGSPGSSPSASTGTGPGASPGTSSTGSPGTPGSGTASSSPGSSTPSGATGSP GTPGSGTASSSPGASPGTSSTGSPGASPGTSSTGSPGTPGSGTASSSPGSSTPSGATGSPG ASPGTSSTGSPGTPGSGTASSSPGSSTPSGATGSPGSSPSASTGTGPGSSPSASTGTGPGS STPSGATGSPGSSTPSGATGSPGASPGTSSTGSPGASPGTSSTGSPGASPGTSSTGSPGG KPGR | 335 |
| Seg 144 | AEATTAAGGAEEEGASPGTSSTGSPGSSPSASTGTGPGSSPSASTGTGPGTPGSGTASSS PGSSTPSGATGSPGSSPSASTGTGPGASPGTSSTGSPGTPGSGTASSSPGSSTPSGATGSP GTPGSGTASSSPGASPGTSSTGSPGASPGTSSTGSPGGKPGR | 336 |
| Seg 145 | AEATTAAGGAEEEGASPGTSSTGSPGSSPSASTGTGPGSSPSASTGTGPGTPGSGTASSS PGSSTPSGATGSPGSSPSASTGTGPGASPGTSSTGSPGTPGSGTASSSPGSSTPSGATGSP GTPGSGTASSSPGASPGTSSTGSPGASPGTSSTGSPGTPGSGTASSSPGSSTPSGATGSPG ASPGTSSTGSPGTPGSGTASSSPGSSTPSGATGSPGSSPSASTGTGPGSSPSASTGTGPGS STPSGATGSPGSSTPSGATGSPGASPGTSSTGSPGASPGTSSTGSPGASPGTSSTGSPGTP GSGTASSSPGASPGTSSTGSPGASPGTSSTGSPGASPGTSSTGSPGSSPSASTGTGPGTPG SGTASSSPGASPGTSSTGSPGASPGTSSTGSPGASPGTSSTGSPGSSTPSGATGSPGSSTP SGATGSPGASPGTSSTGSPGTPGSGTASSSPGSSTPSGATGSPGSSTPSGATGSPGSSTPS GATGSPGSSPSASTGTGPGASPGTSSTGSPGASPGTSSTGSPGTPGSGTASSSPGASPGT SSTGSPGASPGTSSTGSPGASPGTSSTGSPGGKPGR | 337 |

TABLE 3-continued

Cysteine- and lysine-engineered XTEN

| Name | Amino Acid Sequence | SEQ ID NO: |
| --- | --- | --- |
| Seg 146 | AEATTAAGGAEEEGASPGTSSTGSPGSSPSASTGTGPGSSPSASTGTGPGTPGSGTASSS PGSSTPSGATGSPGSSPSASTGTGPGASPGTSSTGSPGTPGSGTASSSPGSSTPSGATGSP GTPGSGTASSSPGASPGTSSTGSPGASPGTSSTGSPGTPGSGTASSSPGSSTPSGATGSPG ASPGTSSTGSPGTPGSGTASSSPGSSTPSGATGSPGSSPSASTGTGPGSSPSASTGTGPGS STPSGATGSPGSSTPSGATGSPGASPGTSSTGSPGASPGTSSTGSPGASPGTSSTGSPGTP GSGTASSSPGASPGTSSTGSPGASPGTSSTGSPGASPGTSSTGSPGSSPSASTGTGPGTPG SGTASSSPGASPGTSSTGSPGASPGTSSTGSPGASPGTSSTGSPGSSTPSGATGSPGSSTP SGATGSPGASPGTSSTGSPGGKPGR | 338 |
| Seg 147 | AEATTAAGGAEEEGASPGTSSTGSPGSSPSASTGTGPGSSPSASTGTGPGTPGSGTASSS PGSSTPSGATGSPGSSPSASTGTGPGASPGTSSTGSPGTPGSGTASSSPGSSTPSGATGSP GTPGSGTASSSPGASPGTSSTGSPGASPGTSSTGSPGTPGSGTASSSPGSSTPSGATGSPG ASPGTSSTGSPGTPGSGTASSSPGSSTPSGATGSPGSSPSASTGTGPGSSPSASTGTGPGS STPSGATGSPGSSTPSGATGSPGASPGTSSTGSPGASPGTSSTGSPGASPGTSSTGSPGG KPGR | 339 |
| Seg 148 | AEATTAAGGAEEEGASPGTSSTGSPGSSPSASTGTGPGSSPSASTGTGPGTPGSGTASSS PGSSTPSGATGSPGSSPSASTGTGPGASPGTSSTGSPGTPGSGTASSSPGSSTPSGATGSP GTPGSGTASSSPGASPGTSSTGSPGASPGTSSTGSPGGKPGR | 340 |
| Seg 149 | GSEPATSGSETPGTSESATPESGPGSEPATSGSETPGSPAGSPTSTEEGTSTEPSEGSAPG SEPATSGSETPGSEPATSGSETPGSEPATSGSETPGTSTEPSEGSAPGTSESATPESGPGS EPATSGSETPGTSTEPSEGSAPGGGSPAGSCTSPGGSPAGSPTSTEEGTSESATPESGPGT STEPSEGSAPGSPAGSPTSTEEGTSTEPSEGSAPGTSTEPSEGSAPGTSESATPESGPGSEP ATSGSETPGSEPATSGSETPGSPAGSPTSTEEGTSESATPESGPGTSTEPSEGSAPGTSTE PSEGSAPGSPAGSPTSTEEGTSTEPSEGSAPGTSTEPSEGSAPGTSESATPESGPGTSTEPS EGSAPGTSESATPESGPGSEPATSGSETPGTSTEPSEGSAPGTSTEPSEGSAPGTSESATP ESGPGTSESATPESGPGSPAGSPTSTEEGTSESATPESGPGSEPATSGSETPGTSESATPE SGPGTSTEPSEGSAPGTSTEPSEGSAPGTSTEPSEGSAPGTSESATPESGPGTSTEPSEGS APGTSTEPSEGSAPGSPAGSPTSTEEGTSTEPSEGSAPGTSESATPESGPGSEPATSGSET PGTSESATPESGPGSEPATSGSETPGTSESATPESGPGTSTEPSEGSAPGTSESATPESGP GSPAGSPTSTEEGSPAGSPTSTEEGSPAGSPTSTEEGTSESATPESGPGTSTEPSEGSAPG | 341 |
| Seg 150 | MAEPAGSPTSTEEGTPGSGTASSSPGSSTPSGATGSPGASPGTSSTGSPGSPAGSPTSTEE GTSESATPESGPGTSTEPSEGSAPGSPAGSPTSTEEGTSTEPSEGSAPGTSTEPSEGSAPG TSESATPESGPGSEPATSGSETPGSEPATSGSETPGSPAGSPTSTEEGTSESATPESGPGT STEPSEGSAPGTSTEPSEGSAPGSPAGSPTSTEEGTSTEPSEGSAPGTSTEPSEGSAPGTS ESATPESGPGTSTEPSEGSAPGTSESATPESGPGSEPATSGSETPGTSTEPSEGSAPGTST EPSEGSAPGTSESATPESGPGTSESATPESGPGSPAGSPTSTEEGTSESATPESGPGSEPA TSGSETPGTSESATPESGPGTSTEPSEGSAPGTSTEPSEGSAPGTSTEPSEGSAPGTSTEPS EGSAPGTSTEPSEGSAPGTSTEPSEGSAPGSPAGSPTSTEEGTSTEPSEGSAPGTSESATP ESGPGSEPATSGSETPGTSESATPESGPGSEPATSGSETPGTSESATPESGPGTSTEPSEG SAPGTSESATPESGPGSPAGSPTSTEEGSPAGSPTSTEEGSPAGSPTSTEEGTSESATPES GPGTSTEPSEGSAPGTSESATPESGPGSEPATSGSETPGTSESATPESGPGSEPATSGSET PGTSESATPESGPGTSTEPSEGSAPGSPAGSPTSTEEGTSESATPESGPGSEPATSGSETP GTSESATPESGPGSPAGSPTSTEEGSPAGSPTSTEEGSPAGSPTSTEEGTSESATPESGPG TSESATPESGPGTSESATPESGPGSEPATSGSETPGSEPATSGSETPGSPAGSPTSTEEGT STEPSEGSAPGTSTEPSEGSAPGSEPATSGSETPGTSESATPESGPGTSTEPSEGSAPGGA SASCAPSTGGGSEPATSGSETPGTSESATPESGPGSEPATSGSETPGSPAGSPTSTEEGTS TEPSEGSAPGSEPATSGSETPGSEPATSGSETPGSEPATSGSETPGTSTEPSEGSAPGTSE SATPESGPGSEPATSGSETPGTSTEPSEGSAPG | 342 |
| Seg 151 | GSPAGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEEGT SESATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPGTST EPSEGSAPGTSTEPSEGSAPGTSESATPESGPGTSESATPESGPGSPAGSPTSTEEGTSES ATPESGPGSEPATSGSETPGTSESATPESGPGTSTEPSEGSAPGTSTEPSEGSAPGTSTEP SEGSAPGTSTEPSEGSAPGTSTEPSEGSAPGTSTEPSEGSAPGSPAGSPTSTEEGTSTEPS EGSAPGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAGSPTS TEEGTSESATPESGPGTSTEPSEGSAPGGGSPAGSCTSPGGSTSESATPESGPGSEPATSGS ETPGTSESATPESGPGSEPATSGSETPGTSESATPESGPGSEPATSGSEPATSGSEPATSGSET EEGTSESATPESGPGSEPATSGSETPGTSESATPESGPGSPAGSPTSTEEGSPAGSPTSTE EGTSTEPSEGSAPGTSESATPESGPGTSESATPESGPGTSESATPESGPGSEPATSGSETP GSEPATSGSETPGSPAGSPTSTEEGTSTEPSEGSAPGTSTEPSEGSAPGSEPATSGSETPG TSESATPESGPGTSTEPSEGSAPG | 343 |
| Seg 152 | MAEPAGSPTSTEEGTPGSGTASSSPGSSTPSGATGSPGASPGTSSTGSPGGPEPTCPAPS GGGSPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTSTEE GTSESATPESGPGTSTEPSEGSAPGTSTEPSEGSAPGSPAGSPTSTEEGTSTEPSEGSAPG TSTEPSEGSAPGTSESATPESGPGTSTEPSEGSAPGTSESATPESGPGSEPATSGSETPGT STEPSEGSAPGTSTEPSEGSAPGTSESATPESGPGTSESATPESGPGSPAGSPTSTEEGTS ESATPESGPGSEPATSGSETPGTSESATPESGPGTSTEPSEGSAPGTSTEPSEGSAPGTST EPSEGSAPGTSTEPSEGSAPGTSTEPSEGSAPGTSTEPSEGSAPGSPAGSPTSTEEGTSTE | 344 |

TABLE 3-continued

Cysteine- and lysine-engineered XTEN

| Name | Amino Acid Sequence | SEQ ID NO: |
|------|---------------------|------------|
| | PSEGSAPGTSESATPESGPGSEPATSGSETPGTSESATPESGPGSEPATSGSETPGTSESA<br>TPESGPGTSTEPSEGSAPGTSESATPESGPGSPAGSPTSTEEGSPAGSPTSTEEGSPAGSP<br>TSTEEGTSESATPESGPGTSTEPSEGSAPGTSESATPESGPGSEPATSGSETPGTSESATP<br>ESGPGSEPATSGSETPGTSESATPESGPGTSTEPSEGSAPGSPAGSPTSTEEGTSESATPE<br>SGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSET<br>PGSPAGSPTSTEEGTSTEPSEGSAPGTSTEPSEGSAPGSEPATSGSETPGTSESATPESGP<br>GTSTEPSEGSAPG | |
| Seg 153 | GTSESATPESGPGSEPATSGSETPGTSESATPESGPGSEPATSGSETPGTSESATPESGPG<br>TSTEPSEGSAPGSPAGSPTSTEEGTSESATPESGPGSEPATSGSETPGTSESATPESGPGSP<br>AGSPTSTEEGSPAGSPTSTEEGTSTEPSEGSAPGTSTE<br>SATPESGPGSEPATSGSETPGSEPATSGSETPGSPAGSPTSTEEGTSTEPSEGSAPGTSTE<br>PSEGSAPGSEPATSGSETPGTSESATPESGPGTSTEPSEGSAPGGGSPAGSCTSPGGTSES<br>ATPESGPGSEPATSGSETPGTSESATPESGPGSEPATSGSETPGTSESATPESGPGTSTEP<br>SEGSAPGSPAGSPTSTEEGTSESATPESGPGSEPATSGSETPGTSESATPESGPGSPAGSP<br>TSTEEGSPAGSPTSTEEGTSTEPSEGSAPGTSESATPESGPGTSESATPESGPGTSESATP<br>ESGPGSEPATSGSETPGSEPATSGSETPGSPAGSPTSTEEGTSTEPSEGSAPGTSTEPSEG<br>SAPGSEPATSGSETPGTSESATPESGPGTSTEPSEGSAPGGGSPAGSCTSPGGTSESATPE<br>SGPGSEPATSGSETPGTSESATPESGPGSEPATSGSETPGTSESATPESGPGTSTEPSEGS<br>APGSPAGSPTSTEEGTSESATPESGPGSEPATSGSETPGTSESATPESGPGSPAGSPTSTE<br>EGSPAGSPTSTEEGTSTEPSEGSAPGTSESATPESGPGTSESATPESGPGTSESATPESGP<br>GSEPATSGSETPGSEPATSGSETPGSPAGSPTSTEEGTSTEPSEGSAPGTSTEPSEGSAPG<br>SEPATSGSETPGTSESATPESGPGTSTEPSEGSAPG | 345 |
| Seg 154 | MAEPAGSPTSTEEGTPGSGTASSSPGSSTPSGATGSPGASPGTSSTGSPGGASASCAPST<br>GGGSPAGSPTSTEEGTSESATPESGPGTSTEPSEGSAPGSPAGSPTSTEEGTSTEPSEGSA<br>PGTSTEPSEGSAPGTSESATPESGPGSEPATSGSETPGSEPATSGSETPGSPAGSPTSTEE<br>GTSESATPESGPGTSTEPSEGSAPGTSTEPSEGSAPGSPAGSPTSTEEGTSTEPSEGSAPG<br>TSTEPSEGSAPGTSESATPESGPGTSTEPSEGSAPGTSESATPESGPGSEPATSGSETPGT<br>STEPSEGSAPGTSTEPSEGSAPGTSESATPESGPGTSESATPESGPGSPAGSPTSTEEGTS<br>ESATPESGPGSEPATSGSETPGTSESATPESGPGTSTEPSEGSAPGTSTEPSEGSAPGTST<br>EPSEGSAPGTSTEPSEGSAPGTSTEPSEGSAPGTSTEPSEGSAPGSPAGSPTSTEEGTSTE<br>PSEGSAPGTSESATPESGPGSEPATSGSETPGTSESATPESGPGSEPATSGSETPGTSESA<br>TPESGPGTSTEPSEGSAPGTSESATPESGPGSPAGSPTSTEEGSPAGSPTSTEEGSPAGSP<br>TSTEEGTSESATPESGPGTSTEPSEGSAPGGASASCAPSTGGGSEPATSGSETPGTSESA<br>TPESGPGSEPATSGSETPGSPAGSPTSTEEGTSTEPSEGSAPGSEPATSGSETPGSEPATS<br>GSETPGSEPATSGSETPGTSTEPSEGSAPGTSESATPESGPGSEPATSGSETPGTSTEPSE<br>GSAPG | 346 |
| Seg 155 | MAEPAGSPTSTEEGASPGTSSTGSPGSSTPSGATGSPGSSTPSGATGSPGGGSPAGSCTS<br>PGGTSTEPSEGSAPGSEPATSGSETPGSPAGSPTSTEEGSTSTAESPGPGTSTPESGSAS<br>PGSTSESPSGTAPGSTSESPSGTAPGTSTPESGSASPGTSTPESGSASPGSEPATSGSETPG<br>TSESATPESGPGSPAGSPTSTEEGTSTEPSEGSAPGTSESATPESGPGTSTEPSEGSAPGT<br>STEPSEGSAPGSPAGSPTSTEEGTSTEPSEGSAPGTSTEPSEGSAPGTSESATPESGPGTS<br>ESATPESGPGTSTEPSEGSAPGTSTEPSEGSAPGTSESATPESGPGSTEPSEGSAPGSEP<br>ATSGSETPGSPAGSPTSTEEGSSTPSGATGSPGTPGSGTASSSPGSSTPSGATGSPGTSTE<br>PSEGSAPGTSTEPSEGSAPGSEPATSGSETPGSPAGSPTSTEEGSPAGSPTSTEEGTSTEPS<br>EGSAPGASASGAPSTGGTSESATPESGPGSPAGSPTSTEEGSPAGSPTSTEEGTSSSTAES<br>PGPGSTSESPSGTAPGTSPSGESSTAPGTPGSGTASSSPGSSTPSGATGSPGSSPSASTGT<br>GPGSEPATSGSETPGTSESATPESGPGSEPATSGSETPGTSSTAESPGPGSTSSTAESPG<br>PGTSPSGESSTAPGSEPATSGSETPGSEPATSGSETPGTSTEPSEGSAPGTSSTAESPGP<br>GTSTPESGSASPGSTSESPSGTAPGTSTEPSEGSAPGTSTEPSEGSAPGTSTEPSEGSAPG<br>SSTPSGATGSPGSSPSASTGTGPGASPGTSSTGSPGSEPATSGSETPGTSESATPESGPGS<br>PAGSPTSTEEGSSTPSGATGSPGSSPSASTGTGPGASPGTSSTGSPGTSESATPESGPGTS<br>TEPSEGSAPGTSTEPSEGSAPG | 347 |
| Seg 156 | MAEPAGSPTSTEEGASPGTSSTGSPGSSTPSGATGSPGSSTPSGATGSPGGASASCAPST<br>GGGTSTEPSEGSAPGSEPATSGSETPGSPAGSPTSTEEGSTSSTAESPGPGTSTPESGSAS<br>PGSTSESPSGTAPGSTSESPSGTAPGTSTPESGSASPGTSTPESGSASPGSEPATSGSETPG<br>TSESATPESGPGSPAGSPTSTEEGTSTEPSEGSAPGTSESATPESGPGTSTEPSEGSAPGT<br>STEPSEGSAPGSPAGSPTSTEEGTSTEPSEGSAPGTSTEPSEGSAPGTSESATPESGPGTS<br>ESATPESGPGTSTEPSEGSAPGTSTEPSEGSAPGTSESATPESGPGSTEPSEGSAPGSEP<br>ATSGSETPGSPAGSPTSTEEGSSTPSGATGSPGTPGSGTASSSPGSSTPSGATGSPGTSTE<br>PSEGSAPGTSTEPSEGSAPGSEPATSGSETPGSPAGSPTSTEEGSPAGSPTSTEEGTSTEPS<br>EGSAPGPEPTGPAPSGGSEPATSGSETPGTSESATPESGPGSPAGSPTSTEEGTSESATPE<br>SGPGSPAGSPTSTEEGSPAGSPTSTEEGTSESATPESGPGSPAGSPTSTEEGSPAGSPTST<br>EEGSTSSTAESPGPGSTSESPSGTAPGTSPSGESSTAPGSTSESPSGTAPGSTSESPSGTAP<br>GTSPSGESSTAPGTSTEPSEGSAPGTSESATPESGPGTSESATPESGPGSEPATSGSETPG<br>TSESATPESGPGTSESATPESGPGTSTEPSEGSAPGTSESATPESGPGTSTEPSEGSAPGT<br>SPSGESSTAPGTSPSGESSTAPGTSPSGESSTAPGTSPSGESSTAPGTSTEEGTSST<br>EPSEGSAPGSSPSASTGTGPGSSTPSGATGSPGSSTPSGATGSPGSSTPSGATGSPGSSTP<br>SGATGSPGASPGTSSTGSPGASASGAPSTGGTSPSGESSTAPGTSSTAESPGPGTSPSGE<br>SSTAPGTSESATPESGPGTSTEPSEGSAPGTSTEPSEGSAPGSSPSASTGTGPGSSTPSGA<br>TGSPGASPGTSSTGSPGTSTPESGSASPGTSPSGESSTAPGTSPSGESSTAPGTSESATPES<br>GPGSEPATSGSETPGTSTEPSEGSAPGTSSESPSGTAPGSTSESPSGTAPGTSTPESGSASP | 348 |

TABLE 3-continued

Cysteine- and lysine-engineered XTEN

| Name | Amino Acid Sequence | SEQ ID NO: |
|---|---|---|
| | GSPAGSPTSTEEGTSESATPESGPGTSTEPSEGSAPGSPAGSPTSTEEGTSESATPESGPG<br>SEPATSGSETPGSSTPSGATGSPGASPGTSSTGSPGSSTPSGATGSPGSTSESPSGTAPGT<br>SPSGESSTAPGSTSSTAESPGPGSSTPSGATGSPGASPGTSSTGSPGTPGSGTASSSPGSP<br>AGSPTSTEEGSPAGSPTSTEEGTSTEPSEGSAPG | |
| Seg 157 | MAEPAGSPTSTEEGASPGTSSTGSPGSSTPSGATGSPGSSTPSGATGSPGGPEPTCPAPS<br>GGGTSTEPSEGSAPGSEPATSGSETPGSPAGSPTSTEEGSTSSTAESPGPGTSTPESGSAS<br>PGSTSESPSGTAPGSTSESPSGTAPGTSTPESGSASPGTSTPESGSASPGSEPATSGSETPG<br>TSESATPESGPGSPAGSPTSTEEGTSTEPSEGSAPGTSESATPESGPGTSTEPSEGSAPGT<br>STEPSEGSAPGSPAGSPTSTEEGTSTEPSEGSAPGTSTEPSEGSAPGTSESATPESGPGTS<br>ESATPESGPGTSTEPSEGSAPGTSTEPSEGSAPGTSESATPESGPGTSTEPSEGSAPGSEP<br>ATSGSETPGSPAGSPTSTEEGSSTPSGATGSPGTPGSGTASSSPGSSTPSGATGSPGTSTE<br>PSEGSAPGTSTEPSEGSAPGSEPATSGSETPGSPAGSPTSTEEGSPAGSPTSTEEGTSTEPS<br>EGSAPGASASGAPSTGGTSESATPESGPGSPAGSPTSTEEGSPAGSPTSTEEGTSSTAES<br>PGPGTSESPSGTAPGTSPSGESSTAPGTPGSGTASSSPGSSTPSGATGSPGSSPSASTGT<br>GPGSEPATSGSETPGTSESATPESGPGSEPATSGSETPGTSSTAESPGPGTSSTAESPG<br>PGTSPSGESSTAPGSEPATSGSETPGSEPATSGSETPGTSTEPSEGSAPGSTSSTAESPGP<br>GTSTPESGSASPGSTSESPSGTAPGTSTEPSEGSAPGTSTEPSEGSAPGTSTEPSEGSAPG<br>SSTPSGATGSPGSSPSASTGTGPGASPGTSSTGSPGSEPATSGSETPGTSESATPESGPGS<br>PAGSPTSTEEGSSTPSGATGSPGSSPSASTGTGPGASPGTSSTGSPGTSESATPESGPGTS<br>TEPSEGSAPGTSTEPSEGSAPG | 349 |
| Seg 158 | MAEPAGSPTSTEEGASPGTSSTGSPGSSTPSGATGSPGSSTPSGATGSPGGPEPTCPAPS<br>GGGTSTEPSEGSAPGSEPATSGSETPGSPAGSPTSTEEGSTSSTAESPGPGTSTPESGSAS<br>PGSTSESPSGTAPGSTSESPSGTAPGTSTPESGSASPGTSTPESGSASPGSEPATSGSETPG<br>TSESATPESGPGSPAGSPTSTEEGTSTEPSEGSAPGTSESATPESGPGTSTEPSEGSAPGT<br>STEPSEGSAPGSPAGSPTSTEEGTSTEPSEGSAPGTSTEPSEGSAPGTSESATPESGPGTS<br>ESATPESGPGTSTEPSEGSAPGTSTEPSEGSAPGTSESATPESGPGTSTEPSEGSAPGSEP<br>ATSGSETPGSPAGSPTSTEEGSSTPSGATGSPGTPGSGTASSSPGSSTPSGATGSPGTSTE<br>PSEGSAPGTSTEPSEGSAPGSEPATSGSETPGSPAGSPTSTEEGSPAGSPTSTEEGTSTEPS<br>EGSAPGASASGAPSTGGTSESATPESGPGSPAGSPTSTEEGSPAGSPTSTEEGTSSTAES<br>PGPGTSESPSGTAPGTSPSGESSTAPGTPGSGTASSSPGSSTPSGATGSPGSSPSASTGT<br>GPGSEPATSGSETPGTSESATPESGPGSEPATSGSETPGTSSTAESPGPGTSSTAESPG<br>PGTSPSGESSTAPGSEPATSGSETPGSEPATSGSETPGTSTEPSEGSAPGSTSSTAESPGP<br>GTSTPESGSASPGSTSESPSGTAPGTSTEPSEGSAPGTSTEPSEGSAPGTSTEPSEGSAPG<br>SSTPSGATGSPGSSPSASTGTGPGASPGTSSTGSPGSEPATSGSETPGTSESATPESGPGS<br>PAGSPTSTEEGSSTPSGATGSPGSSPSASTGTGPGASPGTSSTGSPGTSESATPESGPGTS<br>TEPSEGSAPGTSTEPSEGSAPGGPEPTCPAPSGGMAEPAGSPTSTEEGASPGTSSTGSPG<br>SSTPSGATGSPGSSTPSGATGSPG | 350 |
| Seg 159 | GSEPATSGSETPGTSESATPESGPGSEPATSGSETPGSPAGSPTSTEEGTSTEPSEGSAPG<br>SEPATSGSETPGSEPATSGSETPGSEPATSGSETPGTSTEPSEGSAPGTSESATPESGPG<br>EPATSGSETPGTSTEPSEGSAPGGGSPAGSKTSPGGSPAGSPTSTEEGTSESATPESGPGT<br>STEPSEGSAPGSPAGSPTSTEEGTSTEPSEGSAPGTSTEPSEGSAPGTSESATPESGPGSEP<br>ATSGSETPGSEPATSGSETPGSPAGSPTSTEEGTSESATPESGPGTSTEPSEGSAPGTSTE<br>PSEGSAPGSPAGSPTSTEEGTSTEPSEGSAPGTSTEPSEGSAPGTSESATPESGPGTSTEPS<br>EGSAPGTSESATPESGPGSEPATSGSETPGTSTEPSEGSAPGTSTEPSEGSAPGTSESATP<br>ESGPGTSESATPESGPGSPAGSPTSTEEGTSESATPESGPGSEPATSGSETPGTSESATPE<br>SGPGTSTEPSEGSAPGTSTEPSEGSAPGTSTEPSEGSAPGTSTEPSEGSAPGTSTEPSEGS<br>APGTSTEPSEGSAPGSPAGSPTSTEEGTSTEPSEGSAPGTSESATPESGPGSEPATSGSET<br>PGTSESATPESGPGSEPATSGSETPGTSESATPESGPGTSTEPSEGSAPGTSESATPESGP<br>GSPAGSPTSTEEGSPAGSPTSTEEGSPAGSPTSTEEGTSESATPESGPGTSTEPSEGSAPG | 351 |
| Seg 160 | MAEPAGSPTSTEEGTPGSGTASSSPGSSTPSGATGSPGASPGTSSTGSPGSPAGSPTSTEE<br>GTSESATPESGPGTSTEPSEGSAPGSPAGSPTSTEEGTSTEPSEGSAPGTSTEPSEGSAPG<br>TSESATPESGPGSEPATSGSETPGSEPATSGSETPGSPAGSPTSTEEGTSESATPESGPGT<br>STEPSEGSAPGTSTEPSEGSAPGSPAGSPTSTEEGTSTEPSEGSAPGTSTEPSEGSAPGTS<br>ESATPESGPGTSTEPSEGSAPGTSESATPESGPGSEPATSGSETPGTSTEPSEGSAPGTST<br>EPSEGSAPGTSESATPESGPGTSESATPESGPGSPAGSPTSTEEGTSESATPESGPGSEPA<br>TSGSETPGTSESATPESGPGTSTEPSEGSAPGTSTEPSEGSAPGTSTEPSEGSAPGTSTEPS<br>EGSAPGTSTEPSEGSAPGTSTEPSEGSAPGSPAGSPTSTEEGTSTEPSEGSAPGTSESATP<br>ESGPGSEPATSGSETPGTSESATPESGPGSEPATSGSETPGTSESATPESGPGTSTEPSEG<br>SAPGTSESATPESGPGSPAGSPTSTEEGSPAGSPTSTEEGTSESATPESGPG<br>GPGTSTEPSEGSAPGTSESATPESGPGSEPATSGSETPGTSESATPESGPGSEPATSGSET<br>PGTSESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPESGPG<br>TSESATPESGPGTSESATPESGPGSEPATSGSETPGSPAGSPTSTEEGT<br>STEPSEGSAPGTSTEPSEGSAPGSEPATSGSETPGTSESATPESGPGTSTEPSEGSAPGGA<br>SASKAPSTGGGSEPATSGSETPGTSESATPESGPGSEPATSGSETPGSPAGSPTSTEEGTS<br>TEPSEGSAPGSEPATSGSETPGSEPATSGSETPGSEPATSGSETPGTSTEPSEGSAPGTSE<br>SATPESGPGSEPATSGSETPGTSTEPSEGSAPG | 352 |
| Seg 161 | GSPAGSPTSTEEGTSESATPESGPGTSTEPSEGSAPGSPAGSPTSTEEGTSTEPSEGSAPG<br>TSTEPSEGSAPGTSESATPESGPGSEPATSGSETPGSEPATSGSETPGSPAGSPTSTEEGT<br>SESATPESGPGTSTEPSEGSAPGTSTEPSEGSAPGSPAGSPTSTEEGTSTEPSEGSAPGTS<br>TEPSEGSAPGTSESATPESGPGTSTEPSEGSAPGTSESATPESGPGSEPATSGSETPGTST | 353 |

TABLE 3-continued

Cysteine- and lysine-engineered XTEN

| Name | Amino Acid Sequence | SEQ ID NO: |
|---|---|---|
| | EPSEGSAPGTSTEPSEGSAPGTSESATPESGPGTSESATPESGPGSPAGSPTSTEEGTSES<br>ATPESGPGSEPATSGSETPGTSESATPESGPGTSTEPSEGSAPGTSTEPSEGSAPGTSTEP<br>SEGSAPGTSTEPSEGSAPGTSTEPSEGSAPGTSTEPSEGSAPGSPAGSPTSTEEGTSTEPS<br>EGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTS<br>TEEGTSESATPESGPGTSTEPSEGSAPGGGSPAGSKTSPGGTSESATPESGPGSEPATSGS<br>ETPGTSESATPESGPGSEPATSGSETPGTSESATPESGPGTSTEPSEGSAPGSPAGSPTST<br>EEGTSESATPESGPGSEPATSGSETPGTSESATPESGPGSPAGSPTSTEEGSPAGSPTSTE<br>EGTSTEPSEGSAPGTSESATPESGPGTSESATPESGPGSPAGSPGSEPATSGSETP<br>GSEPATSGSETPGSPAGSPTSTEEGTSTEPSEGSAPGTSTEPSEGSAPGSEPATSGSETPG<br>TSESATPESGPGTSTEPSEGSAPG | |
| Seg 162 | MAEPAGSPTSTEEGTPGSGTASSSPGSSTPSGATGSPGASPGTSSTGSPGGASASKAPST<br>GGGSPAGSPTSTEEGTSESATPESGPGTSTEPSEGSAPGSPAGSPTSTEEGTSTEPSEGSA<br>PGTSTEPSEGSAPGTSESATPESGPGSEPATSGSETPGSEPATSGSETPGSPAGSPTSTEE<br>GTSESATPESGPGTSTEPSEGSAPGTSTEPSEGSAPGSPAGSPTSTEEGTSTEPSEGSAPG<br>TSTEPSEGSAPGTSESATPESGPGTSTEPSEGSAPGTSESATPESGPGSEPATSGSETPGT<br>STEPSEGSAPGTSTEPSEGSAPGTSESATPESGPGTSESATPESGPGSPAGSPTSTEEGTS<br>ESATPESGPGSEPATSGSETPGTSESATPESGPGTSTEPSEGSAPGTSTEPSEGSAPGTST<br>EPSEGSAPGTSTEPSEGSAPGTSTEPSEGSAPGTSTEPSEGSAPGSPAGSPTSTEEGTSTE<br>PSEGSAPGTSESATPESGPGSEPATSGSETPGTSESATPESGPGSEPATSGSETPGTSESA<br>TPESGPGTSTEPSEGSAPGTSESATPESGPGSPAGSPTSTEEGSPAGSPTSTEEGSPAGSP<br>TSTEEGTSESATPESGPGTSTEPSEGSAPGTSESATPESGPGSEPATSGSETPGTSESATP<br>ESGPGSEPATSGSETPGTSESATPESGPGTSTEPSEGSAPGSPAGSPTSTEEGTSESATPE<br>SGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSET<br>PGSPAGSPTSTEEGTSTEPSEGSAPGTSTEPSEGSAPGSEPATSGSETPGTSESATPESGP<br>GTSTEPSEGSAPG | 354 |
| Seg 163 | GTSESATPESGPGSEPATSGSETPGTSESATPESGPGSEPATSGSETPGTSESATPESGPG<br>TSTEPSEGSAPGSPAGSPTSTEEGTSESATPESGPGSEPATSGSETPGTSESATPESGPGSP<br>AGSPTSTEEGSPAGSPTSTEEGTSTEPSEGSAPGTSESATPESGPGTSESATPESGPGTSE<br>SATPESGPGSEPATSGSETPGSEPATSGSETPGSPAGSPTSTEEGTSTEPSEGSAPGTSTE<br>PSEGSAPGSEPATSGSETPGTSESATPESGPGTSTEPSEGSAPGGGSPAGSKTSPGGTSES<br>ATPESGPGSEPATSGSETPGTSESATPESGPGSEPATSGSETPGTSESATPESGPGTSTEP<br>SEGSAPGSPAGSPTSTEEGTSESATPESGPGSEPATSGSETPGTSESATPESGPGSPAGSP<br>TSTEEGSPAGSPTSTEEGTSTEPSEGSAPGTSESATPESGPGTSESATPESGPGTSESATP<br>ESGPGSEPATSGSETPGSEPATSGSETPGSPAGSPTSTEEGTSTEPSEGSAPGTSTEPSEG<br>SAPGSEPATSGSETPGTSESATPESGPGTSTEPSEGSAPGGGSPAGSKTSPGGTSESATPE<br>SGPGSEPATSGSETPGTSESATPESGPGSEPATSGSETPGTSESATPESGPGTSTEPSEGS<br>APGSPAGSPTSTEEGTSESATPESGPGSEPATSGSETPGTSESATPESGPGSPAGSPTSTE<br>EGSPAGSPTSTEEGTSTEPSEGSAPGTSESATPESGPGTSESATPESGPGTSESATPESGP<br>GSEPATSGSETPGSEPATSGSETPGSPAGSPTSTEEGTSTEPSEGSAPGTSTEPSEGSAPG<br>SEPATSGSETPGTSESATPESGPGTSTEPSEGSAPG | 355 |
| Seg 164 | MAEPAGSPTSTEEGTPGSGTASSSPGSSTPSGATGSPGASPGTSSTGSPGGGSPAGSKTS<br>PGGSPAGSPTSTEEGTSESATPESGPGTSTEPSEGSAPGSPAGSPTSTEEGTSTEPSEGSA<br>PGTSTEPSEGSAPGTSESATPESGPGSEPATSGSETPGSEPATSGSETPGSPAGSPTSTEE<br>GTSESATPESGPGTSTEPSEGSAPGTSTEPSEGSAPGSPAGSPTSTEEGTSTEPSEGSAPG<br>TSTEPSEGSAPGTSESATPESGPGTSTEPSEGSAPGTSESATPESGPGSEPATSGSETPGT<br>STEPSEGSAPGTSTEPSEGSAPGTSESATPESGPGTSESATPESGPGSPAGSPTSTEEGTS<br>ESATPESGPGSEPATSGSETPGTSESATPESGPGTSTEPSEGSAPGTSTEPSEGSAPGTST<br>EPSEGSAPGTSTEPSEGSAPGTSTEPSEGSAPGTSTEPSEGSAPGSPAGSPTSTEEGTSTE<br>PSEGSAPGTSESATPESGPGSEPATSGSETPGTSESATPESGPGSEPATSGSETPGTSESA<br>TPESGPGTSTEPSEGSAPGTSESATPESGPGSPAGSPTSTEEGSPAGSPTSTEEGSPAGSP<br>TSTEEGTSESATPESGPGTSTEPSEGSAPGGGSPAGSKTSPGGSEPATSGSETPGTSESAT<br>PESGPGSEPATSGSETPGSPAGSPTSTEEGTSTEPSEGSAPGSEPATSGSETPGSEPATSG<br>SETPGSEPATSGSETPGTSTEPSEGSAPGTSESATPESGPGSEPATSGSETPGTSTEPSEGS<br>APG | 356 |
| Seg 165 | MAEPAGSPTSTEEGASPGTSSTGSPGSSTPSGATGSPGSSTPSGATGSPGGGSPAGSKTS<br>PGGTSTEPSEGSAPGSEPATSGSETPGSPAGSPTSTEEGSTSSTAESPGPGTSTPESGSAS<br>PGSTSESPSGTAPGSTSESPSGTAPGTSTPESGSASPGTSTPESGSASPGSEPATSGSETPG<br>TSESATPESGPGSPAGSPTSTEEGTSTEPSEGSAPGTSESATPESGPGTSTEPSEGSAPGT<br>STEPSEGSAPGSPAGSPTSTEEGTSTEPSEGSAPGTSTEPSEGSAPGTSESATPESGPGTS<br>ESATPESGPGTSTEPSEGSAPGTSTEPSEGSAPGTSESATPESGPGTSTEPSEGSAPGSEP<br>ATSGSETPGSPAGSPTSTEEGSSTPSGATGSPGTPGSTASSSPGSSTPSGATGSPGTSTE<br>PSEGSAPGTSTEPSEGSAPGSEPATSGSETPGSPAGSPTSTEEGSPAGSPTSTEEGTSTEPS<br>EGSAPGASASGAPSTGGTSESATPESGPGSPAGSPTSTEEGSPAGSPTSTEEGSTSSTAES<br>PGPGSTSESPSGTAPGTSPSGESSTAPGTPGSGTASSSPGSSTPSGATGSPGSSPSASTGT<br>GPGSEPATSGSETPGTSESATPESGPGSEPATSGSETPGTSESATPESGPGSTSSTAESPG<br>PGTSPSGESSTAPGSEPATSGSETPGSEPATSGSETPGTSTEPSEGSAPGSTSSTAESPGP<br>GTSTPESGSASPGSTSESPSGTAPGTSTEPSEGSAPGTSTEPSEGSAPGTSTEPSEGSAPG<br>SSTPSGATGSPGSSPSASTGTGPGASPGTSSTGSPGSEPATSGSETPGTSESATPESGPGS<br>PAGSPTSTEEGSSTPSGATGSPGSSPSASTGTGPGASPGTSSTGSPGTSESATPESGPGTS<br>TEPSEGSAPGTSTEPSEGSAPG | 357 |

TABLE 3-continued

Cysteine- and lysine-engineered XTEN

| Name | Amino Acid Sequence | SEQ ID NO: |
|---|---|---|
| Seg 166 | MAEPAGSPTSTEEGASPGTSSTGSPGSSTPSGATGSPGSSTPSGATGSPGGASASKAPST GGGTSTEPSEGSAPGSEPATSGSETPGSPAGSPTSTEEGSTSSTAESPGPGTSTPESGSAS PGSTSESPSGTAPGSTSESPSGTAPGTSTPESGSASPGTSTPESGSASPGSEPATSGSETPG TSESATPESGPGSPAGSPTSTEEGTSTEPSEGSAPGTSESATPESGPGTSTEPSEGSAPGT STEPSEGSAPGSPAGSPTSTEEGTSTEPSEGSAPGTSTEPSEGSAPGTSESATPESGPGTS ESATPESGPGTSTEPSEGSAPGTSTEPSEGSAPGTSESATPESGPGTSTEPSEGSAPGSEP ATSGSETPGSPAGSPTSTEEGSSTPSGATGSPGTPGSGTASSSPGSSTPSGATGSPGTSTE PSEGSAPGTSTEPSEGSAPGSEPATSGSETPGSPAGSPTSTEEGSPAGSPTSTEEGTSTEPS EGSAPGPEPTGPAPSGGSEPATSGSETPGTSESATPESGPGSPAGSPTSTEEGTSESATPE SGPGSPAGSPTSTEEGSPAGSPTSTEEGTSESATPESGPGSPAGSPTSTEEGSPAGSPTST EEGSTSSTAESPGPGSTSESPSGTAPGTSPSGESSTAPGSTSESPSGTAPGSTSESPSGTAP GTSPSGESSTAPGTSTEPSEGSAPGTSESATPESGPGTSESATPESGPGSEPATSGSETPG TSESATPESGPGTSESATPESGPGTSTEPSEGSAPGTSTEPSEGSAPGT SPSGESSTAPGTSPSGESSTAPGTSPSGESSTAPGTSTEPSEGSAPGSPAGSPTSTEEGTST EPSEGSAPGSSPSASTGTGPGSSTPSGATGSPGSSTPSGATGSPGSSTPSGATGSPGSSTP SGATGSPGASPGTSSTGSPGASASGAPSTGGTSPSGESSTAPGSTSSTAESPGPGTSPSGE SSTAPGTSESATPESGPGTSTEPSEGSAPGTSTEPSEGSAPGSSPSASTGTGPGSSTPSGA TGSPGASPGTSSTGSPGTSTPESGSASPGTSPSGESSTAPGTSPSGESSTAPGTSESATPES GPGSEPATSGSETPGTSTEPSEGSAPGTSESPSGTAPGSTSESPSGTAPGTSTPESGSASP GSPAGSPTSTEEGTSESATPESGPGTSTEPSEGSAPGSPAGSPTSTEEGTSESATPESGPG SEPATSGSETPGSSTPSGATGSPGASPGTSSTGSPGSSTPSGATGSPGSTSESPSGTAPGT SPSGESSTAPGSTSSTAESPGPGSSTPSGATGSPGASPGTSSTGSPGTPGSGTASSSPGSP AGSPTSTEEGSPAGSPTSTEEGTSTEPSEGSAPG | 358 |
| Seg 167 | MAEPAGSPTSTEEGASPGTSSTGSPGSSTPSGATGSPGSSTPSGATGSPGGASASKAPST GGGTSTEPSEGSAPGSEPATSGSETPGSPAGSPTSTEEGSTSSTAESPGPGTSTPESGSAS PGSTSESPSGTAPGSTSESPSGTAPGTSTPESGSASPGTSTPESGSASPGSEPATSGSETPG TSESATPESGPGSPAGSPTSTEEGTSTEPSEGSAPGTSESATPESGPGTSTEPSEGSAPGT STEPSEGSAPGSPAGSPTSTEEGTSTEPSEGSAPGTSTEPSEGSAPGTSESATPESGPGTS ESATPESGPGTSTEPSEGSAPGTSTEPSEGSAPGTSESATPESGPGTSTEPSEGSAPGSEP ATSGSETPGSPAGSPTSTEEGSSTPSGATGSPGTPGSGTASSSPGSSTPSGATGSPGTSTE PSEGSAPGTSTEPSEGSAPGSEPATSGSETPGSPAGSPTSTEEGSPAGSPTSTEEGTSTEPS EGSAPGASASGAPSTGGTSESATPESGPGSPAGSPTSTEEGSPAGSPTSTEEGSTSSTAES PGPGSTSESPSGTAPGTSPSGESSTAPGTPGSGTASSSPGSSTPSGATGSPGSSPSASTGT GPGSEPATSGSETPGTSESATPESGPGSEPATSGSETPGTSSTAESPGPGSTSSTAESPG PGTSPSGESSTAPGSEPATSGSETPGSEPATSGSETPGTSTEPSEGSAPGTSSTAESPGP GTSTPESGSASPGSTSESPSGTAPGTSTEPSEGSAPGTSTEPSEGSAPGTSTEPSEGSAPG SSTPSGATGSPGSSPSASTGTGPGASPGTSSTGSPGSEPATSGSETPGTSESATPESGPGS PAGSPTSTEEGSSTPSGATGSPGSSPSASTGTGPGASPGTSSTGSPGTSESATPESGPGTS TEPSEGSAPGTSTEPSEGSAPG | 359 |
| Seg 168 | MAEPAGSPTSTEEGASPGTSSTGSPGSSTPSGATGSPGSSTPSGATGSPGGASASKAPST GGGTSTEPSEGSAPGSEPATSGSETPGSPAGSPTSTEEGSTSSTAESPGPGTSTPESGSAS PGSTSESPSGTAPGSTSESPSGTAPGTSTPESGSASPGTSTPESGSASPGSEPATSGSETPG TSESATPESGPGSPAGSPTSTEEGTSTEPSEGSAPGTSESATPESGPGTSTEPSEGSAPGT STEPSEGSAPGSPAGSPTSTEEGTSTEPSEGSAPGTSTEPSEGSAPGTSESATPESGPGTS ESATPESGPGTSTEPSEGSAPGTSTEPSEGSAPGTSESATPESGPGTSTEPSEGSAPGSEP ATSGSETPGSPAGSPTSTEEGSSTPSGATGSPGTPGSGTASSSPGSSTPSGATGSPGTSTE PSEGSAPGTSTEPSEGSAPGSEPATSGSETPGSPAGSPTSTEEGSPAGSPTSTEEGTSTEPS EGSAPGASASGAPSTGGTSESATPESGPGSPAGSPTSTEEGSPAGSPTSTEEGSTSSTAES PGPGSTSESPSGTAPGTSPSGESSTAPGTPGSGTASSSPGSSTPSGATGSPGSSPSASTGT GPGSEPATSGSETPGTSESATPESGPGSEPATSGSETPGTSSTAESPGPGSTSSTAESPG PGTSPSGESSTAPGSEPATSGSETPGSEPATSGSETPGTSTEPSEGSAPGTSSTAESPGP GTSTPESGSASPGSTSESPSGTAPGTSTEPSEGSAPGTSTEPSEGSAPGTSTEPSEGSAPG SSTPSGATGSPGSSPSASTGTGPGASPGTSSTGSPGSEPATSGSETPGTSESATPESGPGS PAGSPTSTEEGSSTPSGATGSPGSSPSASTGTGPGASPGTSSTGSPGTSESATPESGPGTS TEPSEGSAPGTSTEPSEGSAPGGASASKAPSTGGMAEPAGSPTSTEEGASPGTSSTGSPG SSTPSGATGSPGSSTPSGATGSPG | 360 |
| Seg 169 | GTSESATPESGPGSEPATSGSETPGTSESATPESGPGSEPATSGSETPGTSESATPESGPG TSTEPSEGSAPGSPAGSPTSTEEGTSESATPESGPGSEPATSGSETPGTSESATPESGPGSP AGSPTSTEEGSPAGSPTSTEEGTSTEPSEGSAPGTSESATPESGPGTSESATPESGPGTSE SATPESGPGSEPATSGSETPGTSESATPESGPGSPAGSPTSTEEGTSTEPSEGSAPGTSTE PSEGSAPGSEPATSGSETPGTSESATPESGPGTSTEPSEGSAPGGGSPAGSCTSPGGTSES ATPESGPGSEPATSGSETPGTSESATPESGPGSEPATSGSETPGTSESATPESGPGTSTEP SEGSAPGSPAGSPTSTEEGTSESATPESGPGSEPATSGSETPGTSESATPESGPGSPAGSP TSTEEGSPAGSPTSTEEGTSTEPSEGSAPGTSESATPESGPGTSESATPESGPGTSESATP ESGPGSEPATSGSETPGSEPATSGSETPGSPAGSPTSTEEGTSTEPSEGSAPGTSTEPSEG SAPGSEPATSGSETPGTSESATPESGPGTSTEPSEGSAPGGGSPAGSKTSPGGTSESATPE SGPGSEPATSGSETPGTSESATPESGPGSEPATSGSETPGTSESATPESGPGTSTEPSEGS APGSPAGSPTSTEEGTSESATPESGPGSEPATSGSETPGTSESATPESGPGSPAGSPTSTE EGSPAGSPTSTEEGTSTEPSEGSAPGTSESATPESGPGTSESATPESGPGTSESATPESGP GSEPATSGSETPGSEPATSGSETPGSPAGSPTSTEEGTSTEPSEGSAPGTSTEPSEGSAPG SEPATSGSETPGTSESATPESGPGTSTEPSEGSAPG | 361 |
| Seg 170 | MAEPAGSPTSTEEGTPGSGTASSSPGSSTPSGATGSPGASPGTSSTGSPGGGSPAGSCTS | 362 |

TABLE 3-continued

Cysteine- and lysine-engineered XTEN

| Name | Amino Acid Sequence | SEQ ID NO: |
|---|---|---|
| | PGGSEPATSGSETPGTSESATPESGPGSEPATSGSETPGSPAGSPTSTEEGTSTEPSEGSA<br>PGSEPATSGSETPGSEPATSGSETPGSEPATSGSETPGTSTEPSEGSAPGTSESATPESGP<br>GSEPATSGSETPGTSTEPSEGSAPGGGSPAGSCTSPGSEPATSGSETPGTSESATPESGPG<br>SEPATSGSETPGSPAGSPTSTEEGTSTEPSEGSAPGSEPATSGSETPGSEPATSGSETPGS<br>EPATSGSETPGTSTEPSEGSAPGTSESATPESGPGSEPATSGSETPGTSTEPSEGSAPGGG<br>SPAGSCTSPGGSEPATSGSETPGTSESATPESGPGSEPATSGSETPGSPAGSPTSTEEGTS<br>TEPSEGSAPGSEPATSGSETPGSEPATSGSETPGSEPATSGSETPGTSTEPSEGSAPGTSE<br>SATPESGPGSEPATSGSETPGTSTEPSEGSAPGGGSPAGSCTSPGGSEPATSGSETPGTSE<br>SATPESGPGSEPATSGSETPGSPAGSPTSTEEGTSTEPSEGSAPGSEPATSGSETPGSEPA<br>TSGSETPGSEPATSGSETPGTSTEPSEGSAPGTSESATPESGPGSEPATSGSETPGTSTEPS<br>EGSAPG | |
| Seg 171 | MAEPAGSPTSTEEGTPGSGTASSSPGSSTPSGATGSPGASPGTSSTGSPGGGSPAGSKTS<br>PGGSEPATSGSETPGTSESATPESGPGSEPATSGSETPGSPAGSPTSTEEGTSTEPSEGSA<br>PGSEPATSGSETPGSEPATSGSETPGSEPATSGSETPGTSTEPSEGSAPGTSESATPESGP<br>GSEPATSGSETPGTSTEPSEGSAPGGGSPAGSKTSPGSEPATSGSETPGTSESATPESGPG<br>SEPATSGSETPGSPAGSPTSTEEGTSTEPSEGSAPGSEPATSGSETPGSEPATSGSETPGS<br>EPATSGSETPGTSTEPSEGSAPGTSESATPESGPGSEPATSGSETPGTSTEPSEGSAPGGG<br>SPAGSKTSPGGSEPATSGSETPGTSESATPESGPGSEPATSGSETPGSPAGSPTSTEEGTS<br>TEPSEGSAPGSEPATSGSETPGSEPATSGSETPGSEPATSGSETPGTSTEPSEGSAPGTSE<br>SATPESGPGSEPATSGSETPGTSTEPSEGSAPGGGSPAGSKTSPGGSEPATSGSETPGTSE<br>SATPESGPGSEPATSGSETPGSPAGSPTSTEEGTSTEPSEGSAPGSEPATSGSETPGSEPA<br>TSGSETPGSEPATSGSETPGTSTEPSEGSAPGTSESGPGSEPATSGSETPGTSTEPS<br>EGSAPG | 363 |
| Seg 172 | SAGSPTAEAAGCGTAEAAGTSESATPESGPGSEPATSGSETPGTSESATPESGPGTSTEP<br>SEGSAPGTSESATPESGPGSPAGSPTSTEEGSPAGSPTSTEEGSPAGSPTSTEEGTSESAT<br>PESGPGTSTEPSEGSAPGTSESATPESGPGSEPATSGSETPGTSESATPESGPGSEPATSG<br>SETPGTSESATPESGPGTSTEPSEGSAPTAEAAGCGTAEAAGSPAGSPTSTEEGTSESAT<br>PESGPGSEPATSGSETPGTSESATPESGPGSPAGSPTSTEEGSPAGSPTSTEEGTSTEPSE<br>GSAPGTSESATPESGPGTSESATPESGPGTSESATPESGPGSEPATSGSETPGSEPATSGS<br>ETPGSPAGSPTSTEEGTSTEPSEGSAPGTSTEPSEGSAPGSEPATSGSETPTAEAAGCGT<br>AEAASASR | 364 |
| Seg 173 | SAGSPGSPTSTEEGTSESATPESGPGTSTEPSEGSAPGSPAGSPTSTEEGTSTEPSEGSAP<br>GTSTEPSEGSAPGTSESATPESGPGSEPATSGSETPGSEPATSGSETPGSPAGSPTSTEEG<br>TSESATPESGPGTSTEPSEGSAGPTKPGTSTEPSEGSAPGSPAGSPTSTEEGTSTEPSEGS<br>APGTSTEPSEGSAPGTSESATPESGPGTSTEPSEGSAPGTSESATPESGPGSEPATSGSET<br>PGTSTEPSEGSAPGTSTEPSEGSAPGTSESATPESGPGTSESATPESGPTKPGTSPTSTEE<br>GTSESATPESGPGSEPATSGSETPGTSESATPESGPGTSTEPSEGSAPGTSTEPSEGSAPG<br>TSTEPSEGSAPGTSTEPSEGSAPGTSTEPSEGSAPGTSTEPSEGSAPGSPAGSPTSTEEGT<br>STEPSEGSAPTAEAAGCGTAEAAGTSESATPESGPGSEPATSGSETPGTSESATPESGPG<br>TSTEPSEGSAPGTSESATPESGPGSPAGSPTSTEEGSPAGSPTSTEEGSPAGSPTSTEEGT<br>SESATPESGPGTSTEPSEGSAPGTSESATPESGPGSEPATSGSETPGTSESATPESGPGSEP<br>ATSGSETPGTSESATPESGPGTSTEPSEGSAPTAEAAGCGTAEAAGSPAGSPTSTEEGTS<br>ESATPESGPGSEPATSGSETPGTSESATPESGPGSPAGSPTSTEEGSPAGSPTSTEEGTST<br>EPSEGSAPGTSESATPESGPGTSESATPESGPGTSESATPESGPGSEPATSGSETPGSEPA<br>TSGSETPGSPAGSPTSTEEGTSTEPSEGSAPGTSTEPSEGSAPGSEPATSGSETPTAEAAG<br>CGTAEAASASR | 365 |
| Seg 174 | SAGSPTAEAAGCGTAEAAGSPAGSPTSTEEGTSESATPESGPGTSTEPSEGSAPGSPAGS<br>PTSTEEGTSTEPSEGSAPGTSTEPSEGSAPGTSESATPESGPGSEPATSGSETPGSEPATS<br>GSETPGSPAGSPTSTEEGTSESATPESGPGTSTEPSEGSAPGTSTEPSEGSAPGSPAGSPT<br>STEEGTSTEPSEGSAPGTSTEPSEGSAPGTSESATPESGPGTSTEPSEGSAPGTSESATPES<br>GPGSEPATSGSETPGTSTEPSEGSAPGTSTEPSEGSAPGTSESATPESGPGTSESATPESG<br>PGSPAGSPTSTEEGTSESATPESGPGSEPATSGSETPGTSESATPESGPGTSTEPSEGSAP<br>GTSTEPSEGSAPGTSTEPSEGSAPGTSTEPSEGSAPGTSTEPSEGSAPGTSTEPSEGSAPG<br>SPAGSPTSTEEGTSTEPSEGSAPTAEAAGCGTAEAAGTSESATPESGPGSEPATSGSETP<br>GTSESATPESGPGSEPATSGSETPGTSESATPESGPGTSTEPSEGSAPGTSESATPESGPG<br>SPAGSPTSTEEGSPAGSPTSTEEGSPAGSPTSTEEGTSESATPESGPGTSTEPSEGSAPGT<br>SESATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGTSESATPESGPGSPA<br>GSPTSTEEGSPAGSPTSTEEGTSTEPSEGSAPGTSESATPESGPGTSESATPESGPGTSES<br>ATPESGPGSEPATSGSETPGSEPATSGSETPGSPAGSPTSTEEGTSTEPSEGSAPGTSTEP<br>SEGSAPGSEPATSGSETPGTSESATPESGPGTSTEPSEGSAPTAEAAGCGTAEAASASR | 366 |
| Seg 175 | SAGSPGSPAGSPTSTEEGTSESATPESGPGTSTEPSEGSAPGSPAGSPTSTEEGTSTEPSE<br>GSAPGTSTEPSEGSAPGTSESATPESGPGSEPATSGSETPGSEPATSGSETPGSPAGSPTS<br>TEEGTSESATPESGPGTSTEPSEGSAPGTSTEPSEGSAPGSPAGSPTSTEEGTSTEPSEGS<br>APGTSTEPSEGSAPGTSESATPESGPGTSTEPSEGSAPGTSESATPESGPGSEPATSGSET<br>PGTSTEPSEGSAPGTSTEPSEGSAPGTSESATPESGPGTSESATPESGPGSPAGSPTSTEE<br>GTSESATPESGPGSEPATSGSETPGTSESATPESGPGTSTEPSEGSAPGTSTEPSEGSAPG<br>TSTEPSEGSAPGTSTEPSEGSAPGTSTEPSEGSAPGTSTEPSEGSAPGSPAGSPTSTEEGT<br>STEPSEGSAPTAEAAGCGTAEAAPGSEPATSGSETPGTSESATPESGPGSEPATSGSETP<br>GTAEAAGCGTAEAASTEPSEGSAPGTSESATPESGPGSPAGSPTSTEEGSPATAEAAGC<br>GTAEAASPTSTEEGTSESATPESGPGTSTEPSEGSAPGTSESATTAEAAGCGTAEAASET | 367 |

TABLE 3-continued

Cysteine- and lysine-engineered XTEN

| Name | Amino Acid Sequence | SEQ ID NO: |
|---|---|---|
| | PGTSESATPESGPGSEPATSGSETPGTSESATPESGTAEAAGCGTAEAAGSPAGSPTSTE<br>EGTSESATPESGPGSEPATSGSETPGTTAEAAGCGTAEAAAGSPTSTEEGSPAGSPTSTE<br>EGTSTEPSEGSAPGTSESTAEAAGCGTAEAATPESGPGTSESATPESGPGSEPATSGSET<br>PGSEPATSGTAEAAGCGTAEAATEEGTSTEPSEGSAPGTSTEPSEGSAPGSEPATSGSET<br>PTAEAAGCGTAEAASASR | |
| Seg 176 | SAGSPTAEAAGCGTAEAAGTSESATPESGPGSEPATSGSETPGTSESATPESGPGTSTEP<br>SEGSAPGTSESATPESGPGSPAGSPTSTEEGSPAGSPTSTEEGSPAGSPTSTEEGTSESAT<br>PESGPGTSTEPSEGSAPGTSESATPESGPGSEPATSGSETPGTSESATPESGPGSEPATSG<br>SETPGTSESATPESGPGTSTEPSEGSAPTAEAAGCGTAEAAGSPAGSPTSTEEGTSESAT<br>PESGPGSEPATSGSETPGTSESATPESGPGSPAGSPTSTEEGSPAGSPTSTEEGTSTEPSE<br>GSAPGTSESATPESGPGTSESATPESGPGTSESATPESGPGSEPATSGSETPGSEPATSGS<br>ETPGSPAGSPTSTEEGTSTEPSEGSAPGTSTEPSEGSAPGSEPATSGSETPTAEAAGCGT<br>AEAASASR | 368 |
| Seg 177 | SAGSPTAEAAGCGTAEAAPGSEPATSGSETPGTSESATPESGPGSEPATSGSETPGTAE<br>AAGCGTAEAASTEPSEGSAPGTSESATPESGPGSPAGSPTSTEEGSPATAEAAGCGTAE<br>AASPTSTEEGTSESATPESGPGTSTEPSEGSAPGTSESATTAEAAGCGTAEAASETPGTS<br>ESATPESGPGSEPATSGSETPGTSESATPESGTAEAAGCGTAEAAGSPAGSPTSTEEGTS<br>ESATPESGPGSEPATSGSETPGTTAEAAGCGTAEAAAGSPTSTEEGSPAGSPTSTEEGTS<br>TEPSEGSAPGTSESTAEAAGCGTAEAATPESGPGTSESATPESGPGSEPATSGSETPGSE<br>PATSGTAEAAGCGTAEAATEEGTSTEPSEGSAPGTSTEPSEGSAPGSEPATSGSETPTAE<br>AAGCGTAEAASASR | 369 |
| Seg 178 | SAGSPTGPGSEPATSGSETPGTSESATPESGPGSEPATSGSETPGTSESATPESGPGTSTE<br>PSEGSAPGSPAGSPTSTEEGTSESATPESGPGSEPATSGSETPGTSESATPESGPGSPAGS<br>PTSTEEGSPAGSPTSTEEGTSTEPSEGSAPGTSESATPESGPGTSESATPESGPGTSESATP<br>ESGPGSEPATSGSETPGSEPATSGSETPGSPAGSPTSTEEGTSTEPSEGSAPGTSTEPSEG<br>SAPGSEPATSGSETPGTSESATPESGPGTSTEPSEGSAPSASR | 370 |
| Seg 179 | GSPGSPAGSPTSTEEGTSESATPESGPGTSTEPSEGSAPGSPAGSPTSTEEGTSTEPSEGS<br>APGTSTEPSEGSAPGTSESATPESGPGSEPATSGSETPGSEPATSGSETPGSPAGSPTSTE<br>EGTSESATPESGPGTSTEPSEGSAPGTSTEPSEGSAPGSPAGSPTSTEEGTSTEPSEGSAP<br>GTSTEPSEGSAPGTSESATPESGPGTSTEPSEGSAPGTSESATPESGPGSEPATSGSEPTG<br>TSTEPSEGSAPGTSTEPSEGSAPGTSESATPESGPGTSESATPESGPGSPAGSPTSTEEGT<br>SESATPESGPGSEPATSGSETPGTSESATPESGPGTSTEPSEGSAPGTSTEPSEGSAPGTS<br>TEPSEGSAPGTSTEPSEGSAPGTSTEPSEGSAPGSPAGSPTSTEEGTST<br>EPSEGSAPGTSESATPESGPGSEPATSGSETPGTSESATPESGPGSEPATSGSETPGTSES<br>ATPESGPGTSTEPSEGSAPGTSESATPESGPGSPAGSPTSTEEGSPAGSPTSTEEGSPAGS<br>PTSTEEGTSESATPESGPGTSTEPSEGSAPGTSESATPESGPGSEPATSGSETPGTSESATP<br>ESGPGSEPATSGSETPGTSESATPESGPGTSTEPSEGSAPGSPAGSPTSTEEGTSESATPE<br>SGPGSEPATSGSETPGTSESATPESGPGSPAGSPTSTEEGSPAGSPTSTEEGTSTEPSEGS<br>APGTSESATPESGPGTSESATPESGPGSEPSGPGSEPATSGSETPGSEPATSGSET<br>PGSPAGSPTSTEEGTSTEPSEGSAPGTSTEPSEGSAPGSEPATSGSETPGTSESATPESGP<br>GTSTEPSEGSAPGR | 371 |
| Seg 180 | GSPGSPAGSPTSTEEGTSESATPESGPGTSTEPSEGSAPGSPAGSPTSTEEGTSTEPSEGS<br>APGTSTEPSEGSAPGTSESATPESGPGSEPATSGSETPGSEPATSGSETPGSPAGSPTSTE<br>EGTSESATPESGPGTSTEPSEGSAPGTSTEPSEGSAPGSPAGSPTSTEEGTSTEPSEGSAP<br>GTSTEPSEGSAPGTSESATPESGPGTSTEPSEGSAPGTSESATPESGPGSEPATSGSETPG<br>TSTEPSEGSAPGTSTEPSEGSAPGTSESATPESGPGTSESATPESGPGSPAGSPTSTEEGT<br>SESATPESGPGSEPATSGSETPGTSESATPESGPGTSTEPSEGSAPGTSTEPSEGSAPGTS<br>TEPSEGSAPGTSTEPSEGSAPGTSTEPSEGSAPGTSTEPSEGSAPGSPAGSPTSTEEGTST<br>EPSEGSAPTAEAAGKPGTAEAAGTSESATPESGPGSEPATSGSETPGTSESATPESGPGS<br>EPATSGSETPGTSESATPESGPGTSTEPSEGSAPGTSESATPESGPGSPAGSPTSTEEGSP<br>AGSPTSTEEGSPAGSPTSTEEGTSESATPESGPGTSTEPSEGSAPGTSESATPESGPGSEP<br>ATSGSETPGTSESATPESGPGSEPATSGSETPGTSESATPESGPGTSTEPSEGSAPGSPAG<br>SPTSTEEGTSESATPESGPGSEPATSGSETPGTSESATPESGPGSPAGSPTSTEEGSPAGSP<br>TSTEEGTSTEPSEGSAPGTSESATPESGPGTSESATPESGPGTSESATPESGPGSEPATSG<br>SETPGSEPATSGSETPGSPAGSPTSTEEGTSTEPSEGSAPGTSTEPSEGSAPGSEPATSGS<br>ETPGTSESATPESGPGTSTEPSEGSAPGK | 372 |
| Seg 181 | SAGSPTAEAAGCGTAEAAGSPAGSPTSTEEGTSESATPESGPGTSTEPSEGSAPGSPAGS<br>PTSTEEGTSTEPSEGSAPGTSTEPSEGSAPGTSESATPESGPGSEPATSGSETPGSEPATS<br>GSETPGSPAGSPTSTEEGTSESATPESGPGTSTEPSEGSAPGTSTEPSEGSAPGSPAGSPT<br>STEEGTSTEPSEGSAPGTSTEPSEGSAPGTSESATPESGPGTSTEPSEGSAPGTSESATPES<br>GPGSEPATSGSETPGTSTEPSEGSAPGTSTEPSEGSAPGTSESATPESGPGTSESATPESG<br>PGSPAGSPTSTEEGTSESATPESGPGSEPATSGSETPGTSESATPESGPGTSTEPSEGSAP<br>GTSTEPSEGSAPGTSTEPSEGSAPGTSTEPSEGSAPGTSTEPSEGSAPG<br>SPAGSPTSTEEGTSTEPSEGSAPGTSESATPESGPGSEPATSGSETPGTSESATPESGPGS<br>EPATSGSETPGTSESATPESGPGTSTEPSEGSAPGTSESATPESGPGSPAGSPTSTEEGSP<br>AGSPTSTEEGSPAGSPTSTEEGTSESATPESGPGTSTEPSEGSAPGTSESATPESGPGSEP<br>ATSGSETPGTSESATPESGPGSEPATSGSETPGTSESATPESGPGTSTEPSEGSAPGSPAG<br>SPTSTEEGTSESATPESGPGSEPATSGSETPGTSESATPESGPGSPAGSPTSTEEGSPAGSP | 373 |

TABLE 3-continued

Cysteine- and lysine-engineered XTEN

| Name | Amino Acid Sequence | SEQ ID NO: |
|---|---|---|
| | TSTEEGTSTEPSEGSAPGTSESATPESGPGTSESATPESGPGTSESATPESGPGSEPATSG<br>SETPGSEPATSGSETPGSPAGSPTSTEEGTSTEPSEGSAPGTSTEPSEGSAPGSEPATSGS<br>ETPGTSESATPESGPGTSTEPSEGSAPSASR | |
| Seg 182 | CGSPGSPAGSPTSTEEGTSESATPESGPGTSTEPSEGSAPGSPAGSPTSTEEGTSTEPSEG<br>SAPGTSTEPSEGSAPGTSESATPESGPGSEPATSGSETPGSEPATSGSETPGSPAGSPTST<br>EEGTSESATPESGPGTSTEPSEGSAPGTSTEPSEGSAPGSPAGSPTSTEEGTSTEPSEGSA<br>PGTSTEPSEGSAPGTSESATPESGPGTSTEPSEGSAPGTSESATPESGPGSEPATSGSETP<br>GTSTEPSEGSAPGTSTEPSEGSAPGTSESATPESGPGTSESATPESGPGSPAGSPTSTEEG<br>TSESATPESGPGSEPATSGSETPGTSESATPESGPGTSTEPSEGSAPGTSTEPSEGSAPGT<br>STEPSEGSAPGTSTEPSEGSAPGTSTEPSEGSAPGTSTEPSEGSAPGSPAGSPTSTEEGTS<br>TEPSEGSAPGTSESATPESGPGSEPATSGSETPGTSESATPESGPGSEPATSGSETPGTSE<br>SATPESGPGTSTEPSEGSAPGTSESATPESGPGSPAGSPTSTEEGSPAGSPTSTEEGSPAG<br>SPTSTEEGTSESATPESGPGTSTEPSEGSAPGTSESATPESGPGSEPATSGSETPGTSESAT<br>PESGPGSEPATSGSETPGTSESATPESGPGTSTEPSEGSAPGSPAGSPTSTEEGTSESATP<br>ESGPGSEPATSGSETPGTSESATPESGPGSPAGSPTSTEEGSPAGSPTSTEEGTSTEPSEG<br>SAPGTSESATPESGPGTSESATPESGPGTSESATPESGPGSEPATSGSETPGSEPATSGSE<br>TPGSPAGSPTSTEEGTSTEPSEGSAPGTSTEPSEGSAPGSEPATSGSETPGTSESATPESG<br>PGTSTEPSEGSAPGR | 374 |
| Seg 183 | MKNPEQAEEQAEEQREETRPRPRPRPRPRPRPRPRPRPSASRSAGSPTGPGSEPATSG<br>SETPGTSESATPESGPGSEPATSGSETPGTSESATPESGPGTSTEPSEGSAPGSPAGSPTST<br>EEGTSESATPESGPGSEPATSGSETPGTSESATPESGPGSPAGSPTSTEEGSPAGSPTSTE<br>EGTSTEPSEGSAPGTSESATPESGPGTSESATPESGPGTSESATPESGPGSEPATSGSETP<br>GSEPATSGSETPGSPAGSPTSTEEGTSTEPSEGSAPGTSTEPSEGSAPGSEPATSGSETPG<br>TSESATPESGPGTSTEPSEGSAPSASRSAHHHHHHHH | 375 |
| Seg 184 | MKNPEQAEEQAEEQREETRPRPRPRPRPRPRPRPRPRPSASRSAGSPTAEAAGCGTA<br>EAAPGSEPATSGSETPGTSESATPESGPGSEPATSGSETPGTAEAAGCGTAEAASTEPSE<br>GSAPGTSESATPESGPGSPAGSPTSTEEGSPATAEAAGCGTAEAASPTSTEEGTSESATP<br>ESGPGTSTEPSEGSAPGTSESATTAEAAGCGTAEAASETPGTSESATPESGPGSEPATSG<br>SETPGTSESATPESGTAEAAGCGTAEAAGSPAGSPTSTEEGTSESATPESGPGSEPATSG<br>SETPGTTAEAAGCGTAEAAAGSPTSTEEGSPAGSPTSTEEGTSTEPSEGSAPGTSESTAE<br>AAGCGTAEAATPESGPGTSESATPESGPGSEPATSGSETPGSEPATSGTAEAAGCGTAE<br>AATEEGTSTEPSEGSAPGTSTEPSEGSAPGSEPATSGSETPTAEAAGCGTAEAASASRS<br>AHHHHHHHH | 376 |
| Seg 185 | MKNPEQAEEQAEEQREETRPRPRPRPRPRPRPRPRPRPSASRSAGSPGSPAGSPTSTE<br>EGTSESATPESGPGTSTEPSEGSAPGSPAGSPTSTEEGTSTEPSEGSAPGTSTEPSEGSAP<br>GTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGT<br>SESATPESGPGTSTEPSEGSAPGTSESATPESGPGSEPATSGSETPGTSTEPSEGSAPGTS<br>TEPSEGSAPGTSESATPESGPGTSESATPESGPGSPAGSPTSTEEGTSESATPESGPGSEP<br>ATSGSETPGTSESATPESGPGTSTEPSEGSAPGTSTEPSEGSAPGTSTEPSEGSAPGTSTE<br>PSEGSAPGTSTEPSEGSAPGTSTEPSEGSAPGSPAGSPTSTEEGTSTEPSEGSAPTAEAAG<br>CGTAEAAPGSEPATSGSETPGTSESATPESGPGSEPATSGSETPGTAEAAGCGTAEAAS<br>TEPSEGSAPGTSESATPESGPGSPAGSPTSTEEGSPATAEAAGCGTAEAASPTSTEEGTS<br>ESATPESGPGTSTEPSEGSAPGTSESATTAEAAGCGTAEAASETPGTSESATPESGPGSE<br>PATSGSETPGTSESATPESGTAEAAGCGTAEAAGSPAGSPTSTEEGTSESATPESGPGSE<br>PATSGSETPGTTAEAAGCGTAEAAAGSPTSTEEGSPAGSPTSTEEGTSTEPSEGSAPGTS<br>ESTAEAAGCGTAEAATPESGPGTSESATPESGPGSEPATSGSETPGSEPATSGTAEAAG<br>CGTAEAATEEGTSTEPSEGSAPGTSTEPSEGSAPGSEPATSGSETPTAEAAGCGTAEAA<br>SASRSAHHHHHHHH | 377 |
| Seg 186 | GSPGSPAGSPTSTEEGTSESATPESGPGTSTEPSEGSAPGSPAGSPTSTEEGTSTEPSEGS<br>APGTSTEPSEGSAPGTSESATPESGPGSEPATSGSETPGSEPATSGSETPGSPAGSPTSTE<br>EGTSESATPESGPGTSTEPSEGSAPGTSTEPSEGSAPGSPAGSPTSTEEGTSTEPSEGSAP<br>GTSTEPSEGSAPGTSESATPESGPGTSTEPSEGSAPGTSESATPESGPGSEPATSGSETPG<br>TSTEPSEGSAPGTSTEPSEGSAPGTSESATPESGPGTSESATPESGPGSPAGSPTSTEEGT<br>SESATPESGPGSEPATSGSETPGTSESATPESGPGTSTEPSEGSAPGTSTEPSEGSAPGTS<br>TEPSEGSAPGTSTEPSEGSAPGTSTEPSEGSAPGTSTEPSEGSAPGSPAGSPTSTEEGTST<br>EPSEGSAPTAEAAGKPGTAEAAGTSESATPESGPGSEPATSGSETPGTSESATPESGPGS<br>EPATSGSETPGTSESATPESGPGTSTEPSEGSAPGTSESATPESGPGSPAGSPTSTEEGSP<br>AGSPTSTEEGSPAGSPTSTEEGTSESATPESGPGTSTEPSEGSAPGTSESATPESGPGSEP<br>ATSGSETPGTSESATPESGPGSEPATSGSETPGTSESATPESGPGTSTEPSEGSAPGSPAG<br>SPTSTEEGTSESATPESGPGSEPATSGSETPGTSESATPESGPGSPAGSPTSTEEGSPAGSP<br>TSTEEGTSTEPSEGSAPGTSESATPESGPGTSESATPESGPGTSESATPESGPGSEPATSG<br>SETPGSEPATSGSETPGSPAGSPTSTEEGTSTEPSEGSAPGTSTEPSEGSAPGSEPATSGS<br>ETPGTSESATPESGPGTSTEPSEGSAPGK | 378 |
| Seg 187 | SAGSPTAEAAGCGTAEAAGSPAGSPTSTEEGTSESATPESGPGTSTEPSEGSAPGSPAGS<br>PTSTEEGTSTEPSEGSAPGTSTEPSEGSAPGTSESATPESGPGSEPATSGSETPGSEPATS<br>GSETPGSPAGSPTSTEEGTSESATPESGPGTSTEPSEGSAPGTSTEPSEGSAPGSPAGSPT<br>STEEGTSTEPSEGSAPGTSTEPSEGSAPGTSESATPESGPGTSTEPSEGSAPGTSESATPES<br>GPGSEPATSGSETPGTSTEPSEGSAPGTSTEPSEGSAPGTSESATPESGPGTSESATPESG<br>PGSPAGSPTSTEEGTSESATPESGPGSEPATSGSETPGTSESATPESGPGTSTEPSEGSAP | 379 |

TABLE 3-continued

Cysteine- and lysine-engineered XTEN

| Name | Amino Acid Sequence | SEQ ID NO: |
|---|---|---|
| | GTSTEPSEGSAPGTSTEPSEGSAPGTSTEPSEGSAPGTSTEPSEGSAPG SPAGSPTSTEEGTSTEPSEGSAPGTSESATPESGPGSEPATSGSETPGTSESATPESGPGS EPATSGSETPGTSESATPESGPGTSTEPSEGSAPGTSESATPESGPGSPAGSPTSTEEGSP AGSPTSTEEGSPAGSPTSTEEGTSESATPESGPGTSTEPSEGSAPGTSESATPESGPSEP ATSGSETPGTSESATPESGPGSEPATSGSETPGTSESATPESGPGTSTEPSEGSAPGSPAG SPTSTEEGTSESATPESGPGSEPATSGSETPGTSESATPESGPGSPAGSPTSTEEGSPAGSP TSTEEGTSTEPSEGSAPGTSESATPESGPGTSESATPESGPGTSESATPESGPGSEPATSG SETPGSEPATSGSETPGSPAGSPTSTEEGTSTEPSEGSAPGTSTEPSEGSAPGSEPATSGS ETPGTSESATPESGPGTSTEPSEGSAPSASR | |
| Seg 188 | SAGSPTEGTSTEPSEGSAPGTSESTAEAAGCGTAEAATPESGPGTSESATPESGPGSEPA TSGSETPGSEPATSGTAEAAGCGTAEAATEEGTSTEPSEGSAPGTSTEPSEGSAPGSEPA TSGSETPTAEAAGCGTAEAASASR | 380 |
| Seg 189 | SAGSPTPGTSESATPESGPGSEPATSGSETPGTSESATPESGPGSEPATSGSETPGTSESA TPESGPGTSTEPSEGSAPGTSESATPESGPGSPAGSPTSTEEGSPAGSPTSTEEGSPAGSP TSTEEGTSESATPESGPGTSTEPSEGSAPGTSESATPESGPGSEPATSGSETPGTSESATP ESGPGSEPATSGSETPGTSESATPESGPGTSTEPSEGSAPGSPAGSPTSTEEGTSESATPE SGPGSEPATSGSETPGTSESATPESGPGSPAGSPTSTEEGSPAGSPTSTEEGTSTEPSEGS APGTSESATPESGPGTSESATPESGPGTSESATPESGPGSEPATSGSETPGSEPATSGSET PGSPAGSPTSTEEGTSTEPSEGSAPGTSTEPSEGSAPGSEPATSGSETPTAEAAGCGTAE AASASR | 381 |
| Seg 190 | SAGSPTGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPTAEAAGCGTAEAAGSPAGSPTSTEEGTSESATP ESGPGSEPATSGSETPGTSESATPESGPGSPAGSPTSTEEGSPAGSPTSTEEGTSTEPSEG SAPGTSESTAEAAGCGTAEAATPESGPGTSESATPESGPGSEPATSGSETPGSEPATSGS ETPGSPAGSPTSTEEGTSTEPSEGSAPGTSTEPSEGSAPGSEPATSGSETPTAEAAGCGT AEAASASR | 382 |
| Seg 191 | SAGSPTPGTSESATPESGPGSEPATSGSETPGTSESATPESGPGSEPATSGSETPGTSESA TPESGPGTSTEPSEGSAPGTSESATPESGPGSPAGSPTSTEEGSPAGSPTSTEEGSPAGSP TSTEEGTSESATPESGPGTSTEPSEGSAPGTSESATPESGPGSEPATSGSETPGTSESATP ESGPGSEPATSGSETPGTSESATPESGPGTSTEPSEGSAPGSPAGSPTSTEEGTSESATPE SGPGSEPATSGSETPGTSESATPESGPGSPAGSPTSTEEGSPAGSPTSTEEGTSTEPSEGS APGTSESTAEAAGCGTAEAATPESGPGTSESATPESGPGSEPATSGSETPGSEPATSGTA EAAGCGTAEAATEEGTSTEPSEGSAPGTSTEPSEGSAPGSEPATSGSETPTAEAAGCGT AEAASASR | 383 |
| Seg 192 | SAGSPGSTSSTAESPGPGSTSSTAESPGPGCTSESPSGTAPGSTSSTAESPGPGSTSSTAES PGPGTSTPESGSASPGSTSCSPSGEAPGTSPSGESSTAPGSTSESPSGTAPGSTSESPSGTA PETSPSGESCTAPGSTSASR | 384 |
| Seg 193 | SAGSPGTPGSGTASSSPGSSTPSGATGSPGCAGSGTASSSPGSSTPSGATGSPGTPGSGT ASSSPGSSTPSGATGSPGSSTCSGATGSPGSSPSASTGTGPGSSPSASTGTGPGASPGTSS TGSPGTPGSGTACSSPGSSSASR | 385 |
| Seg 194 | SAGSPGSPAGSPTSTEEGTSESATPESGPGTSTEPSEGSAPGSPAGSPTSTEEGTSTEPSE GSAPGTSTEPSEGSAPGTSESATPESGPGSEPATSGSETPGSEPATSGSETPGSPAGSPTS TEEGTSESATPESGPGTSTEPSEGSAPGTSTEPSEGSAPGSPAGSPTSTEEGTSTEPSEGS APGTSTEPSEGSAPGTSESATPESGPGTSTEPSEGSAPGTSESATPESGPGSEPATSGSET PGTSTEPSEGSAPGTSTEPSEGSAPGTSESATPESGPGTSESATPESGPGSPAGSPTSTEE GTSESATPESGPGSEPATSGSETPGTSESATPESGPGTSTEPSEGSAPGTSTEPSEGSAPG TSTEPSEGSAPGTSTEPSEGSAPGTSTEPSEGSAPGTSTEPSEGSAPGSPAGSPTSTEEGT STEPSEGSAPGTSESATPESGPGSEPATSGSETPGTSESATPESGPGSEPATSGSETPGTS ESATPESGPGTSTEPSEGSAPGTSESATPESGPGSPAGSPTSTEEGSPAGSPTSTEEGSPA GSPTSTEEGTSESATPESGPGTSTEPSEGSAPGTSESATPESGPGSEPATSGSETPGTSES ATPESGPGSEPATSGSETPGTSESATPESGPGTSTEPSEGSAPGSPAGSPTSTEEGTSESA TPESGPGSEPATSGSETPGTSESATPESGPGSPAGSPTSTEEGSPAGSPTSTEEGTSTEPSE GSAPGTSESATPESGPGTSESATPESGPGSEPATSGSETPGSEPATSGS ETPGSPAGSPTSTEEGTSTEPSEGSAPGTSTEPSEGSAPGSEPATSGSETPGTSESATPES GPGTESASK | 386 |
| Seg 195 | SAGSPTGPGSEPATSGSETPGTSESATPESGPGSEPATSGSETPGTSESATPESGPGTSTE PSEGSAPGSPAGSPTSTEEGTSESATPESGPGSEPATSGSETPGTSESATPESGPGSPAGS PTSTEEGSPAGSPTSTEEGTSTEPSEGSAPGTSESATPESGPGTSESATPESGPGTSESATP ESGPGSEPATSGSETPGSEPATSGSETPGSPAGSPTSTEEGTSTEPSEGSAPGTSTEPSEG SAPGSEPATSGSETPGTSESATPESGPGTSTACSEGSAPSASR | 387 |
| Seg 196 | SAGSPTGPGSEPATSGSETPGTSESATPESGPGSEPATSGSETPGTSESATPESGPGTSTE PSEGSAPGSPAGSPTSTEEGTSESATPESGPGSEPATSGSETPGTSESATPESGPGSPAGS PTSTEEGSPAGSPTSTEEGTSTEPSEGSAPGTSESATPESGPGTSESATPESGPGTSESATP ESGPGSEPATSGSETPGSEPATSGSETPGSPAGSPTSTEEGTSTEPSEGSAPGTSTEPSEG SAPGSEPATSGSETPGTSESATPESGPGTSTEPSEGSCASASR | 389 |

TABLE 3-continued

Cysteine- and lysine-engineered XTEN

| Name | Amino Acid Sequence | SEQ ID NO: |
|---|---|---|
| Seg 197 | SAGSPGSCAGSPTSTEEGTSESACPESGPGTSTEPSEGSCPGSPAGSPTSTEEGTCTEPSE GSAPGTSTEPCSGSAPGTSESATPESCPGSEPATSGSETPGSCPATSGSETPGSPAGSCTS TEEGTSESATPESCPGTESASR | |
| Seg 198 | SAGSPTGCGSEPATSGSETPGTSESATPESGPGSEPATSGSETPGTSESATPESGPGTSTE PSEGSAPGSPAGSPTSTEEGTSESATPESGPGSEPATSGSETPGTSESATPESGPGSPAGS PTSTEEGSPAGSPTSTEEGTSCTPSEGSAPGTSESATPESGPGTSESATPESGPGTSESAT PESGPGSEPATSGSETPGSEPATSGSETPGSPAGSPTSTEEGTSTEPSEGSAPGTSTEPSE GSAPGSEPATSGSETPGTSESATPESGPGTSTEPSCGSAPSASR | 390 |
| Seg 199 | SAGSPTGCGSEPATSGSETPGTSESATPESGPGSEPATSGSCTPGTSESATPESGPGTSTE PSEGSAPGSPAGSPCSTEEGTSESATPESGPGSEPATSGSETPGTSESCTPESGPGSPAGS PTSTEEGSPAGSPTSTEEGTSCTPSEGSAPGTSESATPESGPGTSESATPESGPGCSESAT PESGPGSEPATSGSETPGSEPATSGSETCGSPAGSPTSTEEGTSTEPSEGSAPGTSTEPSE GCAPGSEPATSGSETPGTSESATPESGPGTSTEPSCGSAPSASR | 391 |

In another embodiment, the invention provides inserts of lysine as part of a longer sequence defined as a lysine island. Examples of lysine island are shown in Table 4. The benefit of flanking all lysine residues in an XTEN with similar or identical sequence is that it results in a more uniform chemical reactivity for each lysine. Another benefit results from the ability to perform peptide mapping to measure the degree of payload linking. Examples include the islands I_L6, I_L7, and I_L8 of Table 4. These islands comprise glutamate residues that facilitate peptide mapping using GluC protease. In another embodiment, the invention provides inserts of cysteine as part of a longer sequence defined as a cysteine island. Examples of cysteine island are shown in Table 5. The benefit of flanking all cysteine residues in an XTEN with similar or identical sequence is that it results in a more uniform chemical reactivity for each cysteine. Another benefit results from the ability to perform peptide mapping to measure the degree of payload conjugation. Examples include islands I_C4, I_C7, I_C8, and I_C9 of Table 5. These islands comprise glutamate residues that facilitate peptide mapping using GluC protease. The islands can be inserted into constructs encoding the existing XTEN by conventional PCR methods, as described above and in the Examples. Oligonucleotides encoding the islands can be inserted into constructs encoding the existing XTEN by conventional PCR methods. For example, in one embodiment, where an existing full-length XTEN gene is to be modified with nucleotides encoding one or more reactive cysteine or lysine residues, an oligonucleotide can be created that encodes a cysteine or lysine and that exhibits partial homology to and can hybridize with one or more short sequences of the XTEN, resulting in a recombination event and substitution of a cysteine or the lysine codon for an existing codon of the XTEN gene (see, e.g., Examples 6 and 7 for a description of the general methods). In one exemplary embodiment, the recombination results in a replacement with the amino acid sequence GGSPAGSCTSP (SEQ ID NO: 187) of the I_C1 island. However, the oligonucleotides can be designed to place the cysteine (or lysine) in a different location in the motif or to include a second cysteine (or lysine) in the motif. The cysteine- or lysine-encoding oligonucleotides can be designed to hybridize with a given sequence segment at different points along the known XTEN sequence to permit their insertion into an XTEN-encoding gene. Thus, the invention contemplates that multiple XTEN gene constructs can be created with cysteines or lysines inserted at different locations within the XTEN sequence by the selection of restriction sites within the XTEN sequence and the design of oligonucleotides appropriate for the given location and that encode a cysteine or lysine, including use of designed oligonucleotides that result in multiple insertions in the same XTEN sequence. By the design and selection of one or more such oligonucleotides in consideration of the known sequence of the XTEN, and the appropriate use of the methods of the invention, the potential number of substituted reactive cysteine or lysine residues inserted into the full-length XTEN can be estimated and then confirmed by sequencing the resulting XTEN gene.

TABLE 4

Examples of lysine islands

| Designator | Amino Acid Sequence | SEQ ID NO: |
|---|---|---|
| I_L1 | GGSPAGSKPTSP | 392 |
| I_L2 | GASASKPAPSTG | 393 |
| I_L3 | PKP | |
| I_L4 | PPKPP | 394 |
| I_L5 | GGKPG | 395 |
| I_L6 | EGGKPGES | 396 |
| I_L7 | EGGSPAGSKPTSPE | 397 |
| I_L8 | EGASASKPAPSTGE | 398 |

TABLE 5

Examples of cysteine islands

| Designator | Sequence | SEQ ID NO: |
|---|---|---|
| I_C1 | GGSPAGSCTSP | 399 |
| I_C2 | GASASCAPSTG | 400 |
| I_C3 | GPEPTCPAPSG | 401 |
| I_C4 | TAEAAGCGTAEAA | 402 |
| I_C5 | GECEP | 403 |
| I_C6 | GRPCRP | 404 |
| I_C7 | GETSPAGSCTSPTET | 405 |

TABLE 5-continued

Examples of cysteine islands

| Designator | Sequence | SEQ ID NO: |
|---|---|---|
| I_C8 | TESGRPCRPSET | 406 |
| I_C9 | GPEPTCPAPSEG | 407 |

Figure 1A:
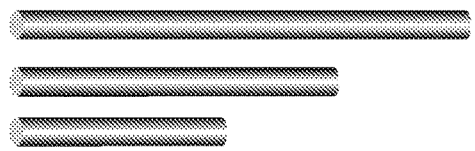
FIG. 1A shows unmodified XTEN.
Figure 1B:
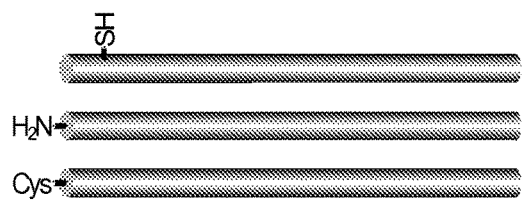
FIG. 1B shows a cysteine-engineered XTEN with an internal cysteine with a thiol side chain; below is an XTEN with an a reactive N-terminal amino group; below is an XTEN with an N-terminal cysteine with a thiol reactive group.
Figure 1C:
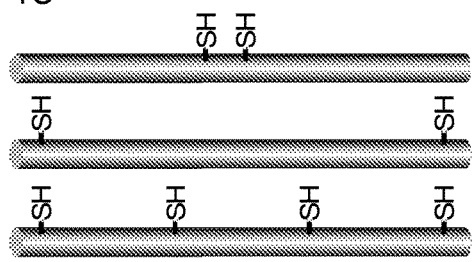
FIG. 1C shows cysteine-engineered XTEN with multiple internal cysteines.
Figure 1E:
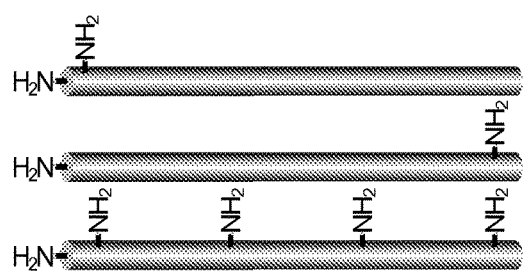
FIG. 1 shows schematics of XTEN suitable for conjugation with payloads.
FIG. 1D shows two variations of a cysteine-engineered XTEN with an internal cysteine with a thiol side chains; and a reactive N-terminal amino group and, at the bottom, a shows a cysteine- and lysine-engineered XTEN with internal cysteines and internal lysines.
Figure 1D:
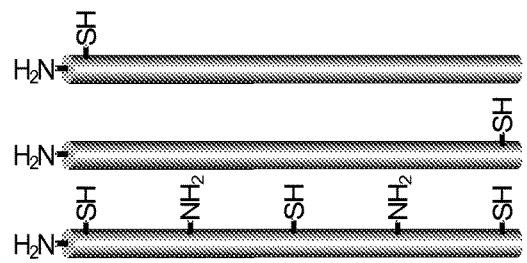

XTEN can be designed to comprise both lysine and cysteine residues for conjugation as illustrated in FIG. 1D. This enables one to conjugate two different payloads to the same XTEN polymer using conjugations methods tailored to react with the functional group or linker attached to the cysteine or lysine. Such mixed payloads can have additive and/or synergistic pharmacologic effects when administered to a subject in a single composition. Alternatively, the mixed payloads can be a combination of a targeting moiety and an active payload in order to deliver the pharmacophore to a desired location in the subject. By controlling the number and position of lysine and cysteine residues one can control the number and position of conjugated payloads. This enables one to adjust the relative potency or selectivity of the payloads in the resulting XTEN-payload conjugate.

The design, selection, and preparation methods of the invention enable the creation of engineered XTEN that are reactive with electrophilic functionality. The methods to make the subject conjugates provided herein enable the creation of XTEN-payload conjugates, XTEN-cross-linker conjugates, and XTEN-azide/alkyne reactant conjugates with the linker or payload molecules added in a quantified fashion at designated sites, as illustrated schematically in FIG. 1. Payloads, cross-linkers, and azide/alkyne reactants may be site-specifically and efficiently linked to the N- or C-terminus of XTEN, to cysteine-engineered XTEN with a thiol-reactive reagent, or to lysine-engineered XTEN of the invention with an amine-reactive reagent, and to an alpha amino group at the N-terminus of XTEN, as described more fully, below, and then are purified and characterized as shown schematically in FIG. 40 using, for example, the non-limiting methods described more specifically in the Examples.

4. Length of Sequence

In another aspect, the invention provides XTEN of varying lengths for incorporation into the compositions wherein the length of the XTEN sequence(s) are chosen based on the property or function to be achieved in the composition. Depending on the intended property or function, the XTEN-payload conjugates comprise short or intermediate length XTEN or longer XTEN sequences, or multimers of short, intermediate or longer XTEN that can serve as carriers. While not intended to be limiting, the XTEN or fragments of XTEN include short segments of about 6 to about 99 amino acid residues, intermediate lengths of about 100 to about 399 amino acid residues, and longer lengths of about 400 to about 1000 and up to about 3000 amino acid residues. Thus, the XTEN utilized as conjugation partners for incorporation into the subject conjugates encompass XTEN or fragments of XTEN with lengths of about 6, or about 12, or about 36, or about 40, or about 48, or about 72 or about 96, or about 144, or about 288, or about 400, or about 432, or about 500, or about 576, or about 600, or about 700, or about 800, or about 864, or about 900, or about 1000, or about 1500, or about 2000, or about 2500, or up to about 3000 amino acid residues in length. In other cases, the XTEN sequences can be about 6 to about 50, about 50 to about 100, about 100 to 150, about 150 to 250, about 250 to 400, about 400 to about 500, about 500 to about 900, about 900 to 1500, about 1500 to 2000, or about 2000 to about 3000 amino acid residues in length. The precise length of an XTEN incorporated into the subject XTEN-payload conjugates can vary without adversely affecting the biological activity of the conjugate. In one embodiment, one or more of the XTEN may be selected from one of the XTEN family sequences; e.g., AD, AE, AF, AG, AM, AQ, BC, or BD. In some embodiments, the XTEN utilized to create the subject conjugates comprise XTEN selected from any one of the sequences in Table 2, Table 3, and Tables 22-25, which may be linked to the payload component directly or via cross-linkers disclosed herein. In other embodiments, the one or more XTEN utilized to create the subject conjugates individually comprise an XTEN sequence having at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to an XTEN selected from Tables 2, 3, 22-25 or a fragment thereof, when optimally aligned with a sequence of comparable length. In some embodiments, the subject conjugates comprise 2, 3, 4, or more XTEN sequence, wherein the cumulative length of the residues in the XTEN sequences is greater than about 100 to about 3000, or about 400 to about 2000, or about 800 to 1000 amino acid residues and the XTEN can be identical or they can be different in sequence or in length. As used herein, cumulative length is intended to encompass the total length, in amino acid residues, when more than one XTEN is incorporated into the conjugate.

As described more fully below, methods are disclosed in which the XTEN-payload conjugates are designed by selecting the length of the XTEN and a method of linking with a cross-linker reactant or the payload to confer a physicochemical property (e.g., stability or solubility) or to result in a target half-life or retention of activity when an XTEN-payload conjugate is administered to a subject.

XTEN are used as a carrier in the compositions, the invention taking advantage of the discovery that increasing the length of the non-repetitive, unstructured polypeptides enhances the unstructured nature of the XTENs and correspondingly enhances the physicochemical and pharmacokinetic properties of constructs comprising the XTEN carrier. In general, XTEN as monomers or as multimers with cumulative lengths longer that about 400 residues incorporated into the conjugates result in longer half-life compared to shorter cumulative lengths, e.g., shorter than about 280 residues. As described more fully in the Examples, proportional increases in the length of the XTEN, even if created by a repeated order of single family sequence motifs (e.g., the four AE motifs of Table 1), result in a sequence with a higher percentage of random coil formation, as determined by GOR algorithm, or reduced content of alpha-helices or beta-sheets, as determined by Chou-Fasman algorithm, compared to shorter XTEN lengths. In addition, increasing the length of the unstructured polypeptide fusion partner, as described in the Examples, results in a construct with a disproportionate increase in terminal half-life compared to polypeptides with unstructured polypeptide partners with shorter sequence lengths. In some embodiments, where the XTEN serve primarily as a carrier, the invention encompasses XTEN conjugate compositions comprising two, three, four or more XTEN wherein the cumulative XTEN sequence length of the XTEN proteins is greater than about 100, 200, 400, 500, 600, 800, 900, or 1000 to about 3000 amino acid residues, wherein the construct exhibits enhanced pharmacokinetic properties when administered to a subject compared to a payload not linked to the XTEN and administered at a comparable dose. In one embodiment of the foregoing, the two or more XTEN sequences each exhibit at least about 80%, 90%/0, 91%, 92%, 93%, 94%, 95%, 96%, 97%, or 98% or more identity to a sequence selected from any one of Table 2, Table 3, or Tables 22-25, and the remainder, if any, of the carrier sequence(s) contains at least 90% hydrophilic amino acids and less than about 2% of the overall sequence consists of hydrophobic or aromatic amino acids or cysteine. The enhanced pharmacokinetic properties of the XTEN-payload conjugate, in comparison to payload not linked to XTEN, are described more fully, below.

5. XTEN Segments from XTEN Precursors

In another aspect, the invention provides methods to create XTEN of short or intermediate lengths from longer "donor" XTEN sequences, wherein the longer donor XTEN sequence is truncated at the N-terminus, or the C-terminus, or segments are created by protealysis of XTEN comprising cleavage sequences, thereby resulting in a short or intermediate length XTEN. In non-limiting examples, an AG864 sequence of 864 amino acid residues can be truncated to yield an AG144 with 144 residues, an AG288 with 288 residues, an AG576 with 576 residues, or other intermediate lengths, while the AE864 sequence can be truncated to yield multiple AE144 sequences, an AE288 sequence or an AE576 sequence with 288 or 576 residues or other shorter or intermediate lengths. Similarly, the DNA encoding the longer "donor" sequences can be manipulated to incorporate cysteine or lysine residues intended for use in conjugates with short or intermediate length XTEN. It is specifically contemplated that such an approach can be utilized with any of the XTEN embodiments described herein or with any of the sequences listed in Tables 2, 3, 21 and 22 to result in XTEN of a desired length.

In another aspect, the invention provides XTEN with cleavage sequences incorporated internal to the sequence at defined intervals such that the XTEN can be processed by cleavage into 2, 3, 4, 5, or 6 shorter XTEN of uniform lengths. As illustrated in FIG. 96A, a monomeric XTEN is designed with two internal cleavage sequences that, when treated with a protease under conditions effective to result in the cleavage of all cleavage sequences, results in three XTEN segments of uniform length. In addition, the XTEN are designed with a sequence such that the resulting XTEN segments also have the identical amino acid sequence, inclusive of the residual cleavage sequence. In one embodiment, the invention provides an XTEN with a defined, sequence comprising 1, 2, 3, 4, or 5 arginine (R) residues internal to the XTEN sequence and spaced at uniform intervals along the XTEN sequence bridging identical XTEN segments wherein treatment with trypsin results in cleavage of the XTEN into XTEN segments to having an identical length and sequence. In the foregoing embodiment, the arginine residue does not have a proline residue at the adjacent P1' position. Thus, by treatment of the foregoing with trypsin, an XTEN with 1 internal arginine would result in 2 identical XTEN segments, an XTEN with 2 internal arginines would result in 3 identical XTEN segments, etc. In another embodiment, each arginine of the foregoing embodiments is replaced with lysine residues. In another embodiment, the invention provides an XTEN with a defined sequence comprising 1, 2, 3, 4, or 5 cleavage sequences internal to the XTEN sequence and spaced at uniform intervals along the XTEN sequence, wherein each cleavage sequence is SASRSA, and wherein treatment with trypsin results in cleavage of the XTEN into XTEN segments to having an identical length and sequence. In another embodiment, the invention provides an XTEN with at least about 90%, or at least about 91%, or at least about 92%, or at least about 93%, or at least about 94%, or at least about 95%, or at least about 96%, or at least about 97%, or at least about 98%, or at least about 99% sequence identity to a sequence selected from the group of sequences set forth in Table 6. In another embodiment, the invention provides an XTEN with at least about 90%, or at least about 91%, or at least about 92%, or at least about 93%, or at least about 94%, or at least about 95%, or at least about 96%, or at least about 970/%, or at least about 98%, or at least about 99% sequence identity to a sequence selected from the group of sequences set forth in Table 6, wherein the XTEN further comprises a first and a second affinity tag wherein each affinity tags are linked to the XTEN by a cleavage sequence at the N- and C-termini of the XTEN, respectively, wherein each cleavage sequence is capable of being cleaved by trypsin, and wherein the first affinity tag is different from the second affinity tag and each is independently selected from the group consisting of the affinity tags set forth in Table 7. The foregoing embodiment is illustrated in FIG. 96B, wherein the treatment with protease of the XTEN with two internal cleavage sequences and an N-terminal and a C-terminal affinity tag each linked to the XTEN by cleavage sequence results in cleavage of the construct into three XTEN segments of uniform length and liberation of the two affinity tags, the resulting preparation of which can be subsequently processed into substantially homogeneous XTEN as described herein, below. Variations of XTEN comprising such uniform cleavage sequences and their distribution in the sequence are contemplated by the invention.

TABLE 6

Precursor XTEN with Internal Cleavage Sequences

| XTEN Name | Amino Acid Sequence | SEQ ID NO: |
|---|---|---|
| AE864_R2 (2x AE432_R1) | SAGSPGSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGSPAGS PTSTEEGTSESATPESGPGTSTEPSEGSAPGTSTEPSEGSAPGSPAGSPTSTEEGTSTEP SEGSAPGTSTEPSEGSAPGTSESATPESGPGTSTEPSEGSAPGTSESATPESGPGSEPAT SGSETPGTSTEPSEGSAPGTSTEPSEGSAPGTSESATPESGPGTSTEPSEGSAPGTSTEP SEGSAPGTSTEPSEGSAPGTSTEPSEGSAPGTSTEPSEGSAPGTSTEPSEGSAPGSPAG SPTSTEEGTESASRSAGSPGSPAGSPTSTEEGTSESATPESGPGTSTEPSEGSAPGSPA GSPTSTEEGTSTEPSEGSAPGTSTEPSEGSAPGTSESATPESGPGSEPATSGSETPGSEP ATSGSETPGSPAGSPTSTEEGTSESATPESGPGTSTEPSEGSAPGTSTEPSEGSAPGSPA GSPTSTEEGTSTEPSEGSAPGTSTEPSEGSAPGTSESATPESGPGTSTEPSEGSAPGTSE SATPESGPGSEPATSGSETPGTSTEPSEGSAPGTSTEPSEGSAPGTSESATPESGPGTSE | 408 |

TABLE 6-continued

Precursor XTEN with Internal Cleavage Sequences

| XTEN Name | Amino Acid Sequence | SEQ ID NO: |
|---|---|---|
| | SATPESGPGSPAGSPTSTEEGTSESATPESGPGSEPATSGSETPGTSESATPESGPGTST<br>EPSEGSAPGTSTEPSEGSAPGTSTEPSEGSAPGTSTEPSEGSAPGTSTEPSEGSAPGTST<br>EPSEGSAPGSPAGSPTSTEEGTESASR | |
| AE864_R3<br>(3x<br>AE288_R1) | SAGSPTGPGSEPATSGSETPGTSESATPESGPGSEPATSGSETPGTSESATPESGPGTST<br>EPSEGSAPGSPAGSPTSTEEGTSESATPESGPGSEPATSGSETPGTSESATPESGPGSPA<br>GSPTSTEEGSPAGSPTSTEEGTSTEPSEGSAPGTSESATPESGPGTSESATPESGPGTSE<br>ATPESGPGSEPATSGSETPGSEPATSGSETPGSPAGSPTSTEEGTSTEPSEGSAPGTST<br>EPSEGSAPGSEPATSGSETPGTSESATPESGPGTSTEPSEGSAPSASRSAGSPTGPGSEP<br>ATSGSETPGTSESATPESGPGSEPATSGSETPGTSESATPESGPGTSTEPSEGSAPGSPA<br>GSPTSTEEGTSESATPESGPGSEPATSGSETPGTSESATPESGPGSPAGSPTSTEEGSPA<br>GSPTSTEEGTSTEPSEGSAPGTSESATPESGPGTSESATPESGPGSEP<br>ATSGSETPGSEPATSGSETPGSPAGSPTSTEEGTSTEPSEGSAPGTSTEPSEGSAPGSEP<br>ATSGSETPGTSESATPESGPGTSTEPSEGSAPSASRSAGSPTGPGSEPATSGSETPGTS<br>ESATPESGPGSEPATSGSETPGTSESATPESGPGTSTEPSEGSAPGSPAGSPTSTEEGTS<br>ESATPESGPGSEPATSGSETPGTSESATPESGPGSPAGSPTSTEEGSPAGSPTSTEEGTS<br>TEPSEGSAPGTSESATPESGPGTSESATPESGPGTSESATPESGPGSEPATSGSETPGSE<br>PATSGSETPGSPAGSPTSTEEGTSTEPSEGSAPGTSTEPSEGSAPGSEPATSGSETPGTS<br>ESATPESGPGTSTEPSEGSAPSASR | 409 |
| AE864_R6<br>(6x<br>AE144_<br>R1) | SAGSPGSPAGSPTSTEEGTSESATPESGPGTSTEPSEGSAPGSPAGSPTSTEEGTSTEPS<br>EGSAPGTSTEPSEGSAPGTSESATPESGPGSEPATSGSETPGSEPATSGSETPGSPAGS<br>PTSTEEGTSESATPESGPGTESASRSAGSPGSPAGSPTSTEEGTSESATPESGPGTSTEP<br>SEGSAPGSPAGSPTSTEEGTSTEPSEGSAPGTSTEPSEGSAPGTSESATPESGPGSEPAT<br>SGSETPGSEPATSGSETPGSPAGSPTSTEEGTSESATPESGPGTESASRSAGSPGSPAG<br>SPTSTEEGTSESATPESGPGTSTEPSEGSAPGSPAGSPTSTEEGTSTEPSEGSAPGTSTE<br>PSEGSAPGTSESATPESGPGSEPATSGSETPGSEPATSGSETPGSPAGSPTSTEEGTSES<br>ATPESGPGTESASRSAGSPGSPAGSPTSTEEGTSESATPESGPGTSTEPSEGSAPGSPA<br>GSPTSTEEGTSTEPSEGSAPGTSTEPSEGSAPGTSESATPESGPGSEPATSGSETPGSEP<br>ATSGSETPGSPAGSPTSTEEGTSESATPESGPGTESASRSAGSPGSPAGSPTSTEEGTS<br>ESATPESGPGTSTEPSEGSAPGSPAGSPTSTEEGTSTEPSEGSAPGTSTEPSEGSAPGTS<br>ESATPESGPGSEPATSGSETPGSEPATSGSETPGSPAGSPTSTEEGTSESATPESGPGTE<br>SASRSAGSPGSPAGSPTSTEEGTSESATPESGPGTSTEPSEGSAPGSPAGSPTSTEEGTS<br>TEPSEGSAPGTSTEPSEGSAPGTSESATPESGPGSEPATSGSETPGSEPATSGSETPGSP<br>AGSPTSTEEGTSESATPESGPGTESASR | 410 |
| Seg 200<br>(3x Seg<br>195) | SAGSPTGPGSEPATSGSETPGTSESATPESGPGSEPATSGSETPGTSESATPESGPGTST<br>EPSEGSAPGSPAGSPTSTEEGTSESATPESGPGSEPATSGSETPGTSESATPESGPGSPA<br>GSPTSTEEGSPAGSPTSTEEGTSTEPSEGSAPGTSESATPESGPGTSESATPESGPGTSE<br>SATPESGPGSEPATSGSETPGSEPATSGSETPGSPAGSPTSTEEGTSTEPSEGSAPGTST<br>EPSEGSAPGSEPATSGSETPGTSESATPESGPGTSTACSEGSAPSASRSAGSPTGPGSE<br>PATSGSETPGTSESATPESGPGSEPATSGSETPGTSESATPESGPGTSTEPSEGSAPGSP<br>AGSPTSTEEGTSESATPESGPGSEPATSGSETPGTSESATPESGPGSPAGSPTSTEEGSP<br>AGSPTSTEEGTSTEPSEGSAPGTSESATPESGPGTSESATPESGPGTSESATPESGPGSE<br>PATSGSETPGSEPATSGSETPGSPAGSPTSTEEGTSTEPSEGSAPGTSTEPSEGSAPGSE<br>PATSGSETPGTSESATPESGPGTSTACSEGSAPSASRSAGSPTGPGSEPATSGSETPGT<br>SESATPESGPGSEPATSGSETPGTSESATPESGPGTSTEPSEGSAPGSPAGSPTSTEEGT<br>SESATPESGPGSEPATSGSETPGTSESATPESGPGSPAGSPTSTEEGSPAGSPTSTEEGT<br>STEPSEGSAPGTSESATPESGPGTSESATPESGPGTSESATPESGPGSEPATSGSETPGS<br>EPATSGSETPGSPAGSPTSTEEGTSTEPSEGSAPGTSTEPSEGSAPGSEPATSGSETPGT<br>SESATPESGPGTSTACSEGSAPSASR | 411 |
| Seg 201<br>(3x Seg<br>196) | SAGSPTGPGSEPATSGSETPGTSESATPESGPGSEPATSGSETPGTSESATPESGPGTST<br>EPSEGSAPGSPAGSPTSTEEGTSESATPESGPGSEPATSGSETPGTSESATPESGPGSPA<br>GSPTSTEEGSPAGSPTSTEEGTSTEPSEGSAPGTSESATPESGPGTSESATPESGPGTSE<br>SATPESGPGSEPATSGSETPGSEPATSGSETPGSPAGSPTSTEEGTSTEPSEGSAPGTST<br>EPSEGSAPGSEPATSGSETPGTSESATPESGPGTSTEPSEGSCASASRSAGSPTGPGSE<br>PATSGSETPGTSESATPESGPGSEPATSGSETPGTSESATPESGPGTSTEPSEGSAPGSP<br>AGSPTSTEEGTSESATPESGPGSEPATSGSETPGTSESATPESGPGSPAGSPTSTEEGSP<br>AGSPTSTEEGTSTEPSEGSAPGTSESATPESGPGTSESATPESGPGTSESATPESGPGSE<br>PATSGSETPGSEPATSGSETPGSPAGSPTSTEEGTSTEPSEGSAPGTSTEPSEGSAPGSE<br>PATSGSETPGTSESATPESGPGTSTEPSEGSCASASRSAGSPTGPGSEPATSGSETPGT<br>SESATPESGPGSEPATSGSETPGTSESATPESGPGTSTEPSEGSAPGSPAGSPTSTEEGT<br>SESATPESGPGSEPATSGSETPGTSESATPESGPGSPAGSPTSTEEGSPAGSPTSTEEGT<br>STEPSEGSAPGTSESATPESGPGTSESATPESGPGTSESATPESGPGSEPATSGSETPGS<br>EPATSGSETPGSPAGSPTSTEEGTSTEPSEGSAPGTSTEPSEGSAPGSEPATSGSETPGT<br>SESATPESGPGTSTEPSEGSCASASR | 412 |

6. Net Charge

In other embodiments, the XTEN polypeptides have an unstructured characteristic imparted by incorporation of amino acid residues with a net charge and containing a low percentage or no hydrophobic amino acids in the XTEN sequence. The overall net charge and net charge density is controlled by modifying the content of charged amino acids in the XTEN sequences, either positive or negative, with the net charge typically represented as the percentage of amino acids in the polypeptide contributing to a charged state beyond those residues that are cancelled by a residue with an opposing charge. In some embodiments, the net charge density of the XTEN of the conjugates may be above +0.1 or below −0.1 charges/residue. By "net charge density" of a protein or peptide herein is meant the net charge divided by the total number of amino acids in the protein. In other embodiments, the net charge of an XTEN can be about 0%, about 1%, about 2%, about 3%, about 4%, about 5%, about 6%, about 7%, about 8%, about 9%, about 10% about 11%, about 12%, about 13%, about 14%, about 15%, about 16%, about 17%, about 18%, about 19%, or about 20% or more. Based on the net charge, some XTENs have an isoelectric point (pI) of 1.0, 1.5, 2.0, 2.5, 3.0, 3.5, 4.0, 4.5, 5.0, 5.5, 6.0, or even 6.5. In one embodiment, the XTEN will have an isoelectric point between 1.5 and 4.5 and carry a net negative charge under physiologic conditions.

Since most tissues and surfaces in a human or animal have a net negative charge, in some embodiments the XTEN sequences are designed to have a net negative charge to minimize non-specific interactions between the XTEN containing compositions and various surfaces such as blood vessels, healthy tissues, or various receptors. Not to be bound by a particular theory, an XTEN can adopt open conformations due to electrostatic repulsion between individual amino acids of the XTEN polypeptide that individually carry a net negative charge and that are distributed across the sequence of the XTEN polypeptide. In some embodiments, the XTEN sequence is designed with at least 90% to 95% of the charged residues separated by other non-charged residues such as serine, alanine, threonine, proline or glycine, which leads to a more uniform distribution of charge, better expression or purification behavior. Such a uniform distribution of net negative charge in the extended sequence lengths of XTEN also contributes to the unstructured conformation of the polymer that, in turn, can result in an effective increase in hydrodynamic radius. In preferred embodiments, the negative charge of the subject XTEN is conferred by incorporation of glutamic acid residues. Generally, the glutamic residues are spaced uniformly across the XTEN sequence. In some cases, the XTEN can contain about 10-80, or about 15-60, or about 20-50 glutamic residues per 20 kDa of XTEN that can result in an XTEN with charged residues that would have very similar pKa, which can increase the charge homogeneity of the product and sharpen its isoelectric point, enhance the physicochemical properties of the resulting XTEN-payload for, and hence, simplifying purification procedures. For example, where an XTEN with a negative charge is desired, the XTEN can be selected solely from an AE family sequence, which has approximately a 17% net charge due to incorporated glutamic acid, or can include varying proportions of glutamic acid-containing motifs of Table 1 to provide the desired degree of net charge. Non-limiting examples of AE XTEN include, but are not limited to the AE36, AE42, AE144, AE288, AE432, AE576, AE624, AE864, and AE912 sequences of Tables 2 and 21 or fragments thereof. In one embodiment, an XTEN sequence of Tables 2 or 3 can be modified to include additional glutamic acid residues to achieve the desired net negative charge. Accordingly, in one embodiment the invention provides XTEN in which the XTEN sequences contain about 1%, 2%, 4%, 8%, 10%, 15%, 17%, 20%, 25%, or even about 30% glutamic acid. In some cases, the XTEN can contain about 10-80, or about 15-60, or about 20-50 glutamic residues per 20 kDa of XTEN that can result in an XTEN with charged residues that would have very similar pKa, which can increase the charge homogeneity of the product and sharpen its isoelectric point, enhance the physicochemical properties of the resulting XTEN conjugate composition, and hence, simplifying purification procedures. In one embodiment, the invention contemplates incorporation of up to 5% aspartic acid residues into XTEN in addition to glutamic acid in order to achieve a net negative charge.

Not to be bound by a particular theory, the XTEN of the XTEN-payload conjugates with the higher net negative charge are expected to have less non-specific interactions with various negatively-charged surfaces such as blood vessels, tissues, or various receptors, which would further contribute to reduced active clearance. Conversely, it is believed that the XTEN of the XTEN-payload conjugates with a low (or no) net charge would have a higher degree of interaction with surfaces that can potentiate the activity of the associated conjugate in the vasculature or tissues.

In other embodiments, where no net charge is desired, the XTEN can be selected from, for example, AG XTEN components, such as the AG motifs of Table 1, or those AM motifs of Table 1 that have no net charge. Non-limiting examples of AG XTEN include, but are not limited to 36, 42, 144, 288, 576, and 864 AG family sequences of Tables 2 and 22, or fragments thereof. In another embodiment, the XTEN can comprise varying proportions of AE and AG motifs in order to have a net charge that is deemed optimal for a given use or to maintain a given physicochemical property.

The XTEN of the conjugates of the present invention generally have no or a low content of positively charged amino acids. In some embodiments, the XTEN may have less than about 10% amino acid residues with a positive charge, or less than about 7%, or less than about 5%, or less than about 2%, or less than about 1% amino acid residues with a positive charge. However, the invention contemplates constructs where a defined number of amino acids with a positive charge, such as lysine, are incorporated into XTEN to permit conjugation between the epsilon amine of the lysine and a reactive group on a payload or a cross-linker to be conjugated to the XTEN backbone. In one embodiment of the foregoing, the XTEN of the subject conjugates has between about 1 to about 100 lysine residues, or about 1 to about 70 lysine residues, or about 1 to about 50 lysine residues, or about 1 to about 30 lysine residues, or about 1 to about 20 lysine residues, or about 1 to about 10 lysine residues, or about 1 to about 5 lysine residues, or about 1 to about 3 lysine residues, or alternatively only a single lysine residue. Using the foregoing lysine-containing XTEN, conjugates can be constructed that comprise XTEN, an optional linker, plus a payload useful in the treatment of a condition in a subject wherein the maximum number of molecules of the payload agent linked to the XTEN component is determined by the numbers of lysines with a reactive side group (e.g., a terminal amine) incorporated into the XTEN.

7. Low Immunogenicity

In another aspect, the invention provides XTEN compositions having a low degree of immunogenicity or are substantially non-immunogenic. Several factors can contribute to the low immunogenicity of XTEN, e.g., the non-repetitive sequence, the unstructured conformation, the high degree of solubility, the low degree or lack of self-aggregation, the low degree or lack of proteolytic sites within the sequence, and the low degree or lack of epitopes in the XTEN sequence.

Conformational epitopes are formed by regions of the protein surface that are composed of multiple discontinuous amino acid sequences of the protein antigen. The precise folding of the protein brings these sequences into a well-defined, stable spatial configurations, or epitopes, that can be recognized as "foreign" by the host humoral immune system, resulting in the production of antibodies to the protein or the activation of a cell-mediated immune response. In the latter case, the immune response to a protein in an individual is heavily influenced by T-cell epitope recognition that is a function of the peptide binding specificity of that individual's HLA-DR allotype. Engagement of a MHC Class II peptide complex by a cognate T-cell receptor on the surface of the T-cell, together with the cross-binding of certain other co-receptors such as the CD4 molecule, can induce an activated state within the T-cell. Activation leads to the release of cytokines further activating other lymphocytes such as B cells to produce antibodies or activating T killer cells as a full cellular immune response.

The ability of a peptide to bind a given MHC Class II molecule for presentation on the surface of an APC (antigen presenting cell) is dependent on a number of factors; most notably its primary sequence. In one embodiment, a lower degree of immunogenicity is achieved by designing XTEN sequences that resist antigen processing in antigen presenting cells, and/or choosing sequences that do not bind MHC receptors well. The invention provides XTEN-payload, XTEN-cross-linker, and XTEN-click-chemistry reactant conjugates with substantially non-repetitive XTEN polypeptides designed to reduce binding with MHC II receptors, as well as avoiding formation of epitopes for T-cell receptor or antibody binding, resulting in a low degree of immunogenicity. Avoidance of immunogenicity can attribute to, at least in part, a result of the conformational flexibility of XTEN sequences; i.e., the lack of secondary structure due to the selection and order of amino acid residues. For example, of particular interest are sequences having a low tendency to adapt compactly folded conformations in aqueous solution or under physiologic conditions that could result in conformational epitopes. The administration of polypeptides comprising XTEN, using conventional therapeutic practices and dosing, would generally not result in the formation of neutralizing antibodies to the XTEN sequence, and also reduce the immunogenicity of the payload in the conjugates.

In one embodiment, the XTEN sequences utilized in the subject polypeptides can be substantially free of epitopes recognized by human T cells. The elimination of such epitopes for the purpose of generating less immunogenic proteins has been disclosed previously; see for example WO 98/52976, WO 02/079232, and WO 00/3317 which are incorporated by reference herein. Assays for human T cell epitopes have been described (Stickler, M., et al. (2003) *J Immunol Methods,* 281: 95-108). Of particular interest are peptide sequences that can be oligomerized without generating T cell epitopes or non-human sequences. This is achieved by testing direct repeats of these sequences for the presence of T-cell epitopes and for the occurrence of 6 to 15-mer and, in particular, 9-mer sequences that are not human, and then altering the design of the XTEN sequence to eliminate or disrupt the epitope sequence. In some embodiments, the XTEN sequences are substantially non-immunogenic by the restriction of the numbers of epitopes of the XTEN predicted to bind MHC receptors. With a reduction in the numbers of epitopes capable of binding to MHC receptors, there is a concomitant reduction in the potential for T cell activation as well as T cell helper function, reduced B cell activation or upregulation and reduced antibody production. The low degree of predicted T-cell epitopes can be determined by epitope prediction algorithms such as, e.g., TEPITOPE (Sturniolo, T., et al. (1999) Nat Biotechnol, 17: 555-61), as shown in Example 46. The TEPITOPE score of a given peptide frame within a protein is the log of the $K_d$ (dissociation constant, affinity, off-rate) of the binding of that peptide frame to multiple of the most common human MHC alleles, as disclosed in Sturniolo, T. et al. (1999) *Nature Biotechnology* 17:555). The score ranges over at least 20 logs, from about 10 to about −10 (corresponding to binding constraints of $10e^{10}$ $K_d$ to $10e^{10}$ $K_d$), and can be reduced by avoiding hydrophobic amino acids that serve as anchor residues during peptide display on MHC, such as M, I, L, V, F. In some embodiments, an XTEN component incorporated into either a XTEN-payload, XTEN-cross-linker, or XTEN-click-chemistry reactant conjugate does not have a predicted T-cell epitope at a TEPITOPE threshold score of about −5, or −6, or −7, or −8, or −9, or at a TEPITOPE score of −10. As used herein, a score of "−9" is a more stringent TEPITOPE threshold than a score of −5.

8. Increased Hydrodynamic Radius

In another aspect, a subject XTEN useful as a fusion partner has a high hydrodynamic radius; a property that confers a corresponding increased apparent molecular weight to the XTEN-payload composition compared to the payload without the XTEN. As detailed in Example 26, the linking of XTEN to therapeutic protein sequences results in compositions that can have increased hydrodynamic radii, increased apparent molecular weight, and increased apparent molecular weight factor compared to a therapeutic protein not linked to an XTEN. For example, in therapeutic applications in which prolonged half-life is desired, compositions in which one or more XTEN with a high hydrodynamic radius are conjugated to a payload can effectively enlarge the hydrodynamic radius of the conjugate beyond the glomerular pore size of approximately 3-5 nm (corresponding to an apparent molecular weight of about 70 kDa) (Caliceti. 2003. Pharmacokinetic and biodistribution properties of poly(ethylene glycol)-protein conjugates. Adv Drug Deliv Rev 55:1261-1277), resulting in reduced renal clearance of circulating proteins with a corresponding increase in terminal half-life and other enhanced pharmacokinetic properties. The hydrodynamic radius of a protein is conferred by its molecular weight as well as by its structure, including shape or compactness. Not to be bound by a particular theory, the XTEN can adopt open conformations due to the electrostatic repulsion between individual charges of incorporated charged residues in the XTEN as wells as because of the inherent flexibility imparted by the particular amino acids in the sequence that lack potential to confer secondary structure. The open, extended and unstructured conformation of the XTEN polypeptide has a greater proportional hydrodynamic radius compared to polypeptides of a comparable sequence length and/or molecular weight that have secondary or tertiary structure, such as typical globular proteins. Methods for determining the hydrodynamic radius are well known in the art, such as by the use of size exclusion chromatography (SEC), as described in U.S. Pat. Nos. 6,406,632 and 7,294,513. Example 26 demonstrates that increases in XTEN length result in proportional increase in the hydrodynamic radius, apparent molecular weight, and/or apparent molecular weight factor, and thus permit the tailoring of an XTEN-payload to desired cut-off values of apparent molecular weights or hydrodynamic radii. Accordingly, in certain embodiments, the XTEN-payload can be configured with an XTEN such that the resulting conjugate can have a hydrodynamic radius of at least about 5 nm, or at least about 8 nm, or at least about 10 nm, or about 12 nm, or about 15 nm, or about 20 nm, or about 30 nm or more. In the foregoing embodiments, the large hydrodynamic radius conferred by the XTEN in a XTEN-payload conjugate can lead to reduced clearance of the resulting conjugate, an increase in terminal half-life, and an increase in mean residence time. As described in the Examples, when the molecular weights of the XTEN-containing compositions are derived from size exclusion chromatography analyses, the open conformation of the XTEN due to the low degree of secondary structure results in an increase in the apparent molecular weight of the conjugates into which they are incorporated. In one embodiment, the present invention makes use of the discovery that the increase in apparent molecular weight can be accomplished by the linking not one of a single XTEN of a given length, but also by the linking of 2, 3, 4 or more XTEN of proportionally shorter lengths, either in linear fashion or as a trimeric or tetrameric, branched configuration, as described more fully, below. In some embodiments, the XTEN comprising a payload and one or more XTEN exhibits an apparent molecular weight of at least about 400 kD, or at least about 500 kD, or at least about 700 kD, or at least about 1000 kD, or at least about 1400 kD, or at least about 1600 kD, or at least about 1800 kD, or at least about 2000 kD. Accordingly, the XTEN-payload conjugate exhibits an apparent molecular weight that is about 1.3-fold greater, or about 2-fold greater, or about 3-fold greater or about 4-fold greater, or about 8-fold greater, or about 10-fold greater, or about 12-fold greater, or about 15-fold, or about 20-fold greater than the actual molecular weight of the conjugate. In one embodiment, the isolated XTEN-payload conjugate of any of the embodiments disclosed herein exhibit an apparent molecular weight factor under physiologic conditions that is greater than about 1.3, or about 2, or about 3, or about 4, or about 5, or about 6, or about 7, or about 8, or about 10, or greater than about 15. In another embodiment, the XTEN-payload has, under physiologic conditions, an apparent molecular weight factor that is about 3 to about 20, or is about 5 to about 15, or is about 8 to about 12, or is about 9 to about 10 relative to the actual molecular weight of the conjugate. Generally, the increased apparent molecular weight of the subject XTEN-payload conjugates enhances the pharmacokinetic properties of the composition by a combination of factors, which include reduced active clearance, reduced renal clearance, and reduced loss through capillary and venous junctions.

9. Compositions and Methods of Purifying XTEN as Substantially Homogeneous Preparations It is an object of the invention to provide compositions of XTEN and methods of making preparations comprising XTEN with a high level of purity and uniformity in the length and composition of the XTEN described herein.

The expression of recombinant XTEN protein or a recombinant fusion protein comprising XTEN in a host cell normally, like any globular protein, results in a mixture of different compounds in which a portion are truncated versions of the desired protein length. The truncation can be the result of early termination of translation, mRNA instability, or proteolysis in the host cell. Because globular proteins generally have efficient or complete folding into their three-dimensional structure while truncated versions do not, typical purification and recovery processes can successfully separate and remove the truncated versions such that a high level of product homogeneity is achieved in a given preparation of globular proteins. However, protein polymers such as XTEN are unique in that, given their unstructured nature, generally lack three-dimensional structures. It has been difficult to obtain a homogeneous preparation of full-length XTENs due to one or more of the above-mentioned reasons. This is because incomplete or truncated XTEN chains differ only slightly in their physicochemical properties from the desired full-length sequences such that traditional processes that would be sufficient for purification of globular proteins are not effective in the removal of truncated XTEN from the expression product in order to obtain a substantially homogeneous preparation of full-length sequences. While the subject XTEN of the invention, including XTEN linked to payload, can be purified to a moderate degree of homogeneity by conventional means used for proteins, such as salt fractionation, ion exchange chromatography, size exclusion chromatography, hydroxyapatite adsorption chromatography, hydrophobic interaction chromatography or gel electrophoresis, these methods alone do not result in preparations wherein the XTEN are substantially homogeneous in sequence length.

The subject methods provided herein permit production of substantially homogenous preparation of XTENs via one or a few simple purification steps. In one embodiment, the practice of any of such methods of the present invention can utilize an XTEN designed to further comprise, as a fusion protein, affinity tags located at either or both of the N- and C-termini of the XTEN such that the expressed product can be subject to purification methods to selectively capture the full-length expressed polypeptide, thereby removing truncated XTEN by-products (see FIGS. 41-42). Non-limiting examples of affinity tags that can be added to the termini of XTEN are presented in Table 7. Non-limiting examples of methods of the design, expression, and purification methods to achieve substantially homogeneous XTEN are described in the Examples.

In some embodiments, the invention provides substantially homogeneous polypeptide compositions with XTEN fused directly to one affinity tag (such as, but not limited to the tags of Table 7) linked to either the N- or C-terminus of the XTEN. In other embodiments, the invention provides substantially homogeneous polypeptide compositions with XTEN fused to one affinity tag (such as, but not limited to the tags of Table 7) by a cleavage sequence linked to either the N- or C-terminus of the XTEN. In other embodiments, the invention provides substantially homogeneous polypeptide compositions with XTEN fused directly to one or two different affinity tags (such as, but not limited to the tags of Table 7) linked to the N- and/or C-termini of the XTEN, as shown in FIG. 41. In other embodiments, the invention provides substantially homogeneous compositions with XTEN fused to one or two cleavage sequences (such as, but not limited to the cleavage sequences of Table 8 or Table 9) which, in turn, are each fused to different affinity tags (such as, but not limited to the tags of Table 7) linked to the N- or C-termini or both the N- and C-termini of the XTEN, as shown in FIG. 41. In yet other embodiments, the invention provides substantially homogeneous polypeptide compositions with XTEN fused directly to one or two different affinity tags (such as, but not limited to the tags of Table 7) linked to the N- and/or C-termini of the XTEN that further comprise a helper sequence (such as, but not limited to the sequences of Table 12) fused to the N-terminus of the protein. As used in the context of the proteins described herein, "substantially homogeneous" means that at least about 85%, or at least about 90%, or at least about 91%, or at least about 92%, or at least about 93%, or at least about 94%, or at least about 95%, 96%, 97%, 98%, 99% or even higher of the polypeptide sequences of the preparation have identical sequence length. The percent values are based on the area percentage of the chromatogram of the preparation analyzed by HPLC or the area percentage of the scan of the preparation analyzed by SDS-PAGE, or by other such standard procedures known in the art for assessing the purity of proteins.

In one embodiment, the invention provides a substantially homogenous polypeptide having the configuration of formula I:

(HS)-(AT1)-(CS1)-(XTEN)   I wherein HS is the helper sequence, AT1 is the first affinity tag, CS1 is the first cleavage sequence, and XTEN is the extended recombinant polypeptide.

In another embodiment, the invention provides a substantially homogenous polypeptide having the configuration of formula II (HS)-(CS1)-(XTEN)-(CS2)-(AT1)   II wherein HS is the helper sequence, AT1 is the first affinity tag, CS1 is the first cleavage sequence, CS2 is the second cleavage sequence and XTEN is the extended recombinant polypeptide.

In another embodiment, wherein the composition has the configuration of formula III:

(HS)-(AT1)-(CS1)-(XTEN)-(CS2)-(AT2)   III wherein HS is the helper sequence, AT1 is the first affinity tag, AT2 is the second affinity tag, CS1 is the first cleavage sequence, CS2 is the second cleavage sequence and XTEN is the extended recombinant polypeptide.

The polypeptide constructs comprising affinity tags have the advantageous property, compared to XTEN not linked to affinity tags, of being able to be purified to substantially homogeneous length by use of chromatography substrates to which the affinity tags will bind. In some embodiments, the categories of chromatography substrates used in the method of purification are selected from the chromatography substrates set forth in Table 7, which are utilized for the purification of XTEN linked to the corresponding the indicated affinity tag in the tables. As will be appreciated by one of skill in the art, the categories of chromatography substrate can encompass different chemical groups linked to different matrices or resins; e.g., anion exchange substrates include quaternary trimethylamminonium and diethylaminoethyl bound to resins, cation exchange substrates include sulfo or sulfopropyl or carboxymethyl or phosphate groups bound to resins, HIC substrates include ethyl, isopropyl, butyl, phenyl or octyl groups bound to resins, and IMAC substrates include iminodiacetic acid and nitriloacetic acid groups bound to resins. The foregoing substrates are listed for illustrative purposes and are not intended to limit the scope of substrates that can be employed to practice the invention.

Figure 42:
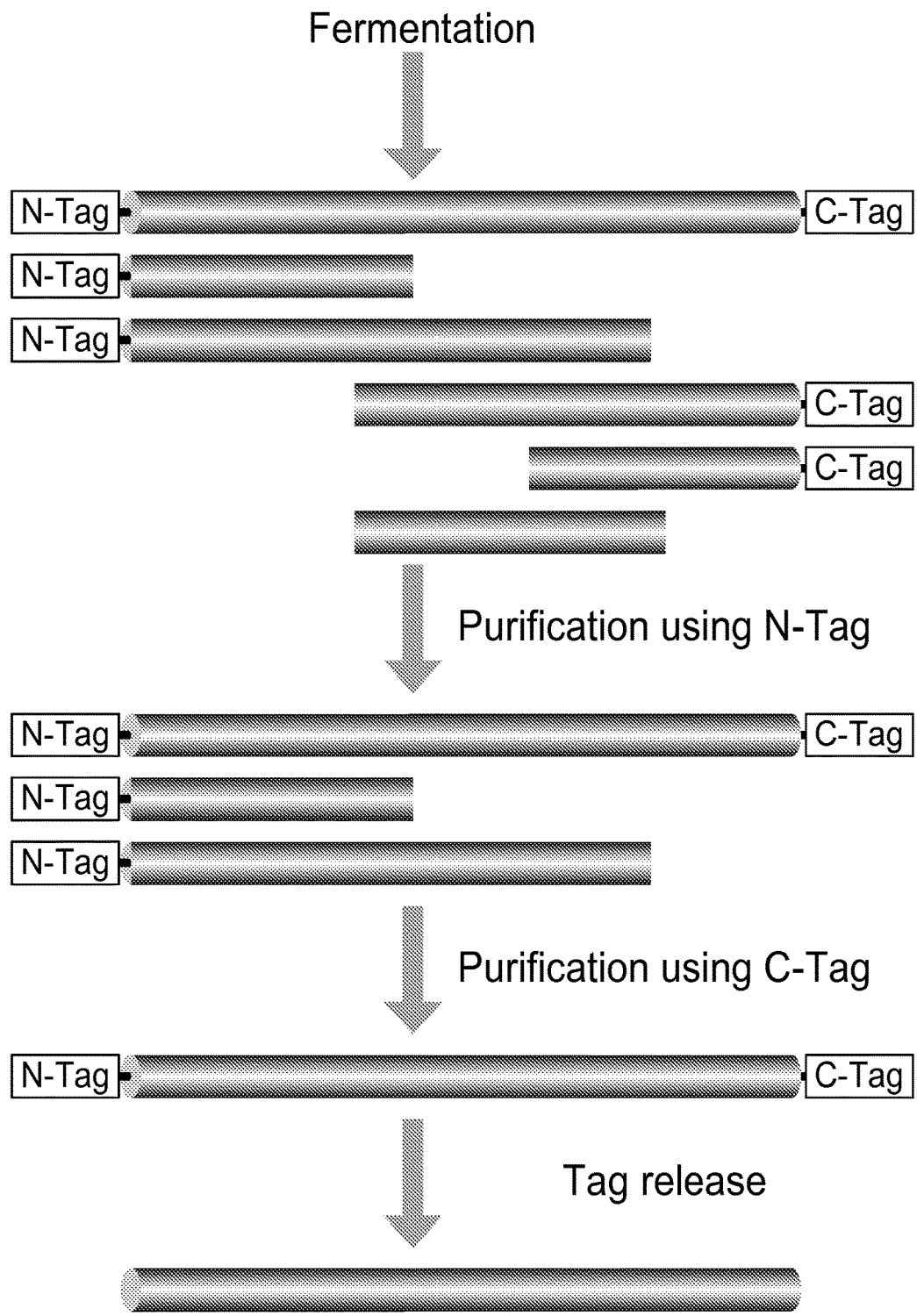
FIG. 42 shows a generalized scheme for purification of XTEN with, in this illustrative embodiment, two tags in which a two-step purification method to capture first one tag and then the second can be utilized to remove truncated XTEN from fermentation, resulting in the highly purified target XTEN entity.

In some embodiments, the invention provides substantially homogeneous XTEN prepared from the a polypeptide comprising an XTEN fused to a first or a first and a second affinity tag by cleavage sequences (such as, but not limited to the cleavage sequences of Table 8) capable of being cleaved by a protease, wherein the preparation is treated with the protease to cleave the cleavage sequences to release the XTEN from the polypeptide, followed by a chromatography step to bind and then elute, and then recover the substantially homogeneous XTEN. In one embodiment of the foregoing, the protease is trypsin and the cleavage sequences are capable of being cleaved by trypsin, non-limiting examples of which are listed in Tables 11 and 15. In another embodiment of the foregoing, the protease is TEV and the cleavage sequences are capable of being cleaved by TEV. In another embodiment of the foregoing, the cleaved XTEN is purified by binding to MacoCap SP chromatography substrate followed by elution with a salt or buffer solution such as, but not limited to, sodium phosphate/NaCl, resulting in the substantially homogenous XTEN. As used in the context of XTEN and/or polypeptides comprising XTEN, a preparation that is "substantially purified" means that at least about 85%, and more preferably at least about 90%, and more preferably at least about 91%, and more preferably at least about 92%, and more preferably at least about 93%, and more preferably at least about 94%, and more preferably at least about 95% or more of the individual molecules of a given preparation have identical sequence length; in other words, the same number of amino acids. The methods that can be utilized to assay for homogeneity of length include mass spectroscopy, size exclusion chromatography/HPLC, or SDS-PAGE followed by silver staining; the methods can be used individually or collectively to quantitate the degree of homogeneity. A generalized scheme for purification of polypeptides comprising XTEN with affinity tag sequences optimized for purification is shown in FIGS. 41-42. After purification the tags can be proteolytically cleaved (FIG. 41B) or retained (FIG. 41C). The XTEN can be purified from contaminants due to the unique amino acid composition of XTEN, as illustrated in FIG. 42.

In one embodiment, the invention provides a method to produce a substantially purified preparation of a polypeptide comprising an XTEN, comprising the steps of designing a gene encoding an XTEN and a first affinity tag, creating an expression vector suitable for transforming a host cell comprising the encoding gene operably linked to control sequences, transforming the host cell with the expression vector, culturing the host cell under conditions suitable for the expression of the XTEN with linked affinity tag, subjecting the crude expression product to a purification process that comprises an affinity purification step wherein the crude expression product is loaded onto a first chromatography substrate that selectively binds the first affinity tag, washing the chromatography substrate to elute material not bound to the chromatography substrate, eluting the retained protein under appropriate conditions and recovering the eluate wherein the recovered polypeptide is substantially homogeneous in length. In another embodiment, the invention provides a method to produce a substantially homogeneous preparation of a polypeptide comprising an XTEN, comprising the steps of designing a gene encoding an XTEN comprising a first and a second affinity tag, creating an expression vector suitable for transforming a host cell comprising the encoding gene operably linked to control sequences, transforming the host cell with the expression vector, culturing the host cell under conditions suitable for the expression of the polypeptide, subjecting the crude expression product to a purification process that comprises an affinity purification step wherein the lysate is loaded onto a first chromatography substrate that selectively binds the first affinity tag, washing the chromatography substrate to elute material not bound to the chromatography substrate, eluting the retained protein under appropriate conditions and recovering the eluate, loading the recovered XTEN polypeptide onto a second chromatography substrate under conditions effective to capture the polypeptide with the second affinity tag onto the chromatography substrate, washing the chromatography substrate to elute material not bound to the chromatography substrate, eluting the XTEN polypeptide under conditions effective to elute the XTEN polypeptide with the second affinity tag, recovering the eluate containing the polypeptide comprising the XTEN polypeptide with the first and the second affinity tag wherein the recovered polypeptide is substantially homogeneous in length. In yet another embodiment, the invention provides a method to produce a substantially homogeneous preparation of a polypeptide comprising an XTEN, comprising the steps of designing a gene encoding an XTEN comprising a first affinity tag linked by a cleavage sequence to the N-terminus of the encoded XTEN and a second affinity tag linked by a cleavage sequence to the C-terminus of the encoded XTEN, creating an expression vector suitable for transforming a host cell comprising the encoding gene operably linked to control sequences, transforming the host cell with the expression vector, culturing the host cell under conditions suitable for the expression of the polypeptide, subjecting the crude expression product to a purification process that comprises an affinity purification step wherein the lysate is loaded onto a first chromatography substrate that selectively binds the first affinity tag, washing the chromatography substrate to elute material not bound to the chromatography substrate, eluting the retained protein under appropriate conditions and recovering the eluate, loading the recovered polypeptide onto a second chromatography substrate under conditions effective to capture the polypeptide with the second affinity tag onto the chromatography substrate, washing the chromatography substrate to elute material not bound to the chromatography substrate, eluting the polypeptide under conditions effective to elute the polypeptide with the second affinity tag, then treating the recovered polypeptide with a protease under conditions effective to release the XTEN from the polypeptide and loading the material onto a chromatography substrate capable of capturing the XTEN but not the affinity tags, washing the chromatography substrate to elute material not bound to the chromatography substrate, eluting the XTEN, recovering the eluate containing the XTEN polypeptide wherein the recovered XTEN is substantially homogeneous in length. In one embodiment of the foregoing methods described in this paragraph, the first and second affinity tags are selected from the group of affinity tags set forth in Table 7. In one embodiment of the method, the first affinity tag linked to the XTEN as a fusion protein comprises the sequence RPRPRPRPRPRPR (SEQ ID NO: 17) and the chromatography substrate used to bind the polypeptide is MacroCap SP. In another embodiment of the foregoing methods, the first affinity tag linked to a first terminus of the XTEN as a fusion protein comprises the sequence RPRPRPRPRPRPRPRPRPRPRPR (SEQ ID NO: 19), the second affinity tag linked to a second terminus of the XTEN comprises the sequence HHHHHHHH (SEQ ID NO: 20), the first chromatography substrate used to bind the polypeptide is MacroCap SP, and the second chromatography substrate used to bind the polypeptide is an immobilized metal on affinity (IMAC) substrate. In another embodiment of the foregoing methods, the first affinity tag fused to a cleavage sequence fused to a first terminus of the XTEN as a fusion protein comprises the sequence RPRPRPRPRPRPR (SEQ ID NO: 17) or RPRPRPRPRPRPRPRPRPRPRPR (SEQ ID NO: 19), the second affinity tag fused to a cleavage sequence to a second terminus of the XTEN comprises the sequence HHHHHH (SEQ ID NO: 18) or HHHHHHHH (SEQ ID NO: 20), the first chromatography substrate used to bind the polypeptide is MacroCap SP, the second chromatography substrate used to bind the polypeptide is a immobilized metal on affinity (IMAC) substrate, the cleavage sequences comprise an arginine or lysine (including, but not limited to the sequences of Tables 8 and 9) and are cleaved by trypsin, and Macrocap Q is the chromatography substrate used to bind the XTEN freed from the affinity tags or, in the alternative, the freed XTEN is captures as flow-through by passing the protease-treated preparation through one or more of cation exchange, HIC and/or IMAC to capture the cleavage products and protease, leaving the XTEN in the flow-through, which is then recovered as a substantially homogeneous preparation.

It will be appreciated by one of skill in the art that the order and specific conditions of the steps of the method will vary depending on the composition of the XTEN-affinity tag polypeptide as well as the starting expression level and degree of contamination of truncated contaminants. For example, with certain XTEN compositions, the use of a single affinity tag linked to the XTEN will be sufficient to achieve a preparation in which the polypeptide molecules are substantially homogeneous in length. In such cases, in one embodiment the single affinity tag is selected from the affinity tags set forth in Table 7. With other XTEN compositions, the use of a first and a second affinity tag will be sufficient to achieve a preparation in which the polypeptide molecules are substantially homogeneous in length and in such cases, in one embodiment, the first and second affinity tags are different and each is selected from the affinity tags set forth in Table 7. It will be further appreciated by one of skill in the art that once the polypeptides comprising cleavage sequences are purified, the recovered polypeptide can be subsequently treated by proteolysis to release the one or two affinity tags, followed by passing the treated XTEN through a chromatography substrate to recover the XTEN without linked affinity tags. A schematic of the method is illustrated in FIG. 42 and exemplary methodologies are described in the Examples. Many different proteases can be utilized for the release of terminal purification tags, depending on the sequence linking the affinity tag to the XTEN, including but not limited to a protease selected from Table 9. In one embodiment, the protease is selected from the group consisting of trypsin, chymotrypsin, tobacco etch mosaic virus protease (TEV), FXa, and enterokinase. In another embodiment, the cleavage sequence incorporated into the polypeptide comprises an arginine residue that can be cleaved and the affinity tag removed by treatment with trypsin, thereby releasing the XTEN that is subsequently recovered in substantially purified form by chromatography such as, by capture using anion exchange (including but not limited to, MacroCap Q) or recovered as flow-through wherein the non-XTEN cleavage products and protease are captured by one or more of HIC, cation exchange, or IMAC chromatography, leaving substantially homogeneous XTEN in the flow-through.

TABLE 7

Affinity Tags and Chromatography Substrate Categories that Bind Affinity Tags

| Affinity Tag Amino Acid Sequence | SEQ ID NO: | Chromatography Substrate |
|---|---|---|
| LYPYPYP, LYYYPP, WPWP, FPFPFP | 413-416 | HIC |
| $(Y)_n$, $(W)_n$, $(YP)_n$, $(WP)_n$, $(FP)_n$, $(LP)_n$ with n = 3-20 | 417-422 | HIC |

TABLE 7-continued

Affinity Tags and Chromatography Substrate Categories that Bind Affinity Tags

| Affinity Tag Amino Acid Sequence | SEQ ID NO: | Chromatography Substrate |
|---|---|---|
| $(RP)_n$, $(KP)_n$, $(HP)_n$, $(H)_n$, $(R)_n$ with n = 3-20 | 423-427 | Cation exchange, IMAC |
| $(E)_n$, $(D)_n$, $(ED)_n$, $(EP)_n$, $(DP)_n$ with n = 3-20 | 428-432 | Anion exchange |
| RPRPRPRPRP | 433 | Cation exchange |
| RPRPRPRPRPGR | 434 | Cation exchange |
| RPRPRPRPRPRPRP | 435 | Cation exchange |
| RPRPRPRPRPRPRPGR | 436 | Cation exchange |
| KPKPKPKPKP | 437 | Cation exchange |
| KPKPKPKPKPGR | 438 | Cation exchange |
| RPRPRPRPRPRPRPRPRP | 439 | Cation exchange |
| RPRPRPRPRPRPRPRPRPGR | 440 | Cation exchange |
| RPRPRPRPRPRPRPRPRPRPRP | 441 | Cation exchange |
| RPRPRPRPRPRPRPRPRPRPRPGR | 442 | Cation exchange |
| RPRPRPRPRPRPRPRPRPRPRPRPRP | 443 | Cation exchange |
| RPRPKPRPKPRPKPRPKP | 444 | Cation exchange |
| PRPKPRPKPRPKPRPKPGR | 445 | Cation exchange |
| RPRPKPRPKPRPKPRPKPRPKP | 446 | Cation exchange |
| RPRPKPRPKPRPKPRPKPRPKPGR | 447 | Cation exchange |
| GSPYGYPYSYS, GSPWGSPTSTE, GSPAGSPTSTE, | 448-450 | HIC |
| GSPXGXPXSXS, GSPSGXPXSXS, GSPSGTPXSXS where X = Ile, Leu, Val, Phe, Trp, or Tyr | 451-453 | HIC |
| GSPXGXPXSXS, GSPSGXPXSXS, GSPSGTPXSXS where X = Arg, Lys, or His | 454-456 | Cation exchange, IMAC |
| HHHHHH, HHHHHHHH | 18 and 20 | IMAC |
| STRPSRRSRRG, STRRGTRRGTRRG, | 457-458 | Cation exchange |
| STRPSRGRARG, STRPSRRARG, STRPSRRRRG, | 459-461 | Cation exchange |
| STEPSEESEEG, STEEGTEEGTEEG, | 462-463 | Anion exchange |
| STEPSEGEAEG, STEPSEEAEG, STEPSEEEEG, | 464-466 | Anion exchange |

TABLE 8

Trypsin Cleavage Sequences

| P4 | P3 | P2 | P1 | P1' | P2' |
|---|---|---|---|---|---|
| S | A | S | R | S | A |
| S | A | S | K | S | A |
| G | S | G | R | A | T |
| E | A | A | R | H | H |
| A | P | G | R | H | H |
| G | S | G | R | G | S |
|  |  |  | R | X* |  |
|  |  |  | K | X* |  |

*X = any L-amino acid other than proline

TABLE 9

Proteases and Protease Cleavage Sequences

| Protease Acting Upon Sequence | Exemplary Cleavage Sequence | SEQ ID NO: | Cleavage Sequences* | SEQ ID NO: |
|---|---|---|---|---|
| FXIa | KLTR↓AET | 473 | KD/FL/T/R↓VA/VE/GT/GV | |
| FXIa | DFTR↓VVG | 474 | KD/FL/T/R↓VA/VE/GT/GV | |
| FXIIa | TMTR↓IVGG | 475 | | |
| Kallikrein | SPFR↓STGG | 476 | -/-/FL/RY↓SR/RT/-/- | |
| FVIIa | LQVR↓IVGG | 477 | | |
| FIXa | PLGR↓IVGG | 478 | -/-/G/R↓-/-/-/- | |
| FXa | IEGR↓TVGG | 479 | IA/E/GFP/R↓STI/VFS/-/G | |
| FIIa (thrombin) | LTPR↓SLLV | 480 | -/-/PLA/R↓SAG/-/-/- | |
| Elastase-2 | LGPV↓SGVP | 481 | -/-/-/VIAT↓-/-/-/- | |
| Granzyme-B | VAGD↓SLEE | 482 | V/-/-/D↓-/-/-/- | |
| MMP-12 | GPAG↓LGGA | 483 | G/PA/-/G↓L/-/G/- | 491 |
| MMP-13 | GPAG↓LRGA | 484 | G/P/-/G↓L/-/GA/- | 492 |
| MMP-17 | APLG↓LRLR | 485 | -/P S/-/-↓LQ/-/LT/- | |
| MMP-20 | PALP↓LVAQ | 486 | | 493 |
| TEV | ENLYFQ↓G | 487 | ENLYFQ↓G/S | 488 |
| Enterokinase | DDDK↓IVGG | 488 | DDDK↓IVGG | |
| Protease 3C (PreScission™) | LEVLFQ↓GP | 489 | LEVLFQ↓GP | 489 |
| Sortase A | LPKT↓GSES | 490 | L/P/KEAD/T↓G/-/EKS/S | 494 |
| Trypsin | K↓X** or R↓X | | K/X or R/X | |
| Trypsin | R↓X** | | SASRSA | 21 |

↓indicates cleavage site
*the listing of multiple amino acids before, between, or after a slash indicate alternative amino acids that can be substituted at the position; "-" indicates that any amino acid may be substituted for the corresponding amino acid indicated in the middle column
**x is any L-amino acid other than proline In another embodiment, XTEN can be designed such that one or both affinity tags linked to the termini and used to facilitate purification can remain part of the final product, eliminating the requirement for a protease release step. If purification tags are designed to remain a part of a drug product, then tag sequences are selected that do not elicit a pronounced immune response. Immunogenicity can be predicted using computational prediction algorithms or experimental assays. Sequence, that avoid T-cell and B-cell epitopes are preferred. Non-limiting examples of sequences incorporated into the terminus of XTEN sequences that facilitate capture and that may optionally remain associated with the conjugate constructs are provided in Table 7.

10. Compositions for Increased Expression of XTEN

In another aspect, the invention provides constructs comprising polynucleic acid sequences encoding XTEN and methods of making the XTEN for use in the subject conjugates in which additional encoding polynucleotide helper sequences are added to the 5' end of polynucleotides encoding the XTEN or are added to the 5' end of sequences encoding an affinity tag linked to the 5' end of sequences encoding an XTEN to enhance and facilitate the expression of the XTEN or XTEN with cleavage sequences linked to affinity tag polypeptides in transformed host cells, such as bacteria. Examples of such encoded helper sequences are given in Table 10 and in the Examples. In one embodiment, the invention provides a polynucleotide sequence construct encoding a polypeptide comprising a helper sequence having at least about 80%, or at least about 90%, or at least about 95%, or at least about 96%, or at least about 97%, or at least about 98%, or at least about 99% sequence identity to a sequence selected from Table 10 linked to the N-terminus of a first affinity tag selected from the group of sequences set forth in Table 7 that, in turn, is either linked to a cleavage sequence described herein or directly to the N-terminus of an XTEN having at least about 90%, or at least about 91%, or at least about 92%, or at least about 93%, or at least about 94% sequence identity, or at least about 95%, or at least about 96%, or at least about 97%, or at least about 98%, or at least about 99% to a sequence selected from the group of sequences set forth in Tables 2 and 3. The invention provides expression vectors encoding the constructs useful in methods to produce substantially homogeneous preparations of polypeptides and XTEN at high expression levels. In some embodiments, the invention provides methods for producing a substantially homogenous population of polypeptides comprising an XTEN and a first and a second affinity tag and a helper sequence, the method comprising culturing in a fermentation reaction a host cell that comprises a vector encoding a polypeptide comprising an XTEN and the first and second affinity tag under conditions effective to express the polypeptide such that more than about 2 g/L, or more than about 3 g/L, or more than about 4 g/L, or more than about 5 g/L, or more than about 6 g/L, or more than about 7 grams per liter (7 g/L) of the polypeptide is produced as a component of a crude expression product of the host cell when the fermentation reaction reaches an optical density of at least 130 at a wavelength of 600 nm. In one embodiment, the method further comprises the steps of adsorbing the polypeptide onto a first chromatography substrate under conditions effective to capture the first affinity tag of the polypeptide onto the chromatography substrate; eluting and recovering the polypeptide; adsorbing the polypeptide onto a second chromatography substrate under conditions effective to capture the second affinity tag of the polypeptide onto the chromatography substrate; eluting the polypeptide; and recovering the substantially homogeneous polypeptide preparation. In one embodiment of the foregoing method, the vector further comprises nucleotides encoding a helper sequence at the N-terminus of the encoded polypeptide wherein the helper sequence has at least 80%, or at least 90%, or at least 95% sequence identity to a sequence set forth in Table 10. In other embodiments, the invention provides methods for producing a substantially homogenous population of polypeptides comprising an XTEN and a first and a second affinity tag and a helper sequence, the method comprising culturing in a fermentation reaction a host cell that comprises a vector encoding a polypeptide comprising an XTEN and the first and second affinity tag under conditions effective to express the polypeptide product at a concentration of more than about 10 milligrams/gram of dry weight host cell (mg/g), or at least about 250 micromoles/L, or about 300 micromoles/L, or about 350 micromoles/L, or about 400 micromoles/L, or about 450 micromoles/L, or about 500 micromoles/L of said polypeptide when the fermentation reaction reaches an optical density of at least 130 at a wavelength of 600 nm. In one embodiment of the foregoing, the method further comprises the steps of adsorbing the polypeptide onto a first chromatography substrate under conditions effective to capture the first affinity tag of the polypeptide onto the chromatography substrate; eluting and recovering the polypeptide; adsorbing the polypeptide onto a second chromatography substrate under conditions effective to capture the second affinity tag of the polypeptide onto the chromatography substrate; eluting the polypeptide; and recovering the substantially homogeneous polypeptide preparation. In one embodiment of the foregoing method, the vector further comprises nucleotides encoding a helper sequence at the N-terminus of the encoded polypeptide wherein the helper sequence has at least 80%, or at least 90%, or at least 95% sequence identity to a sequence set forth in Table 10. In other embodiments, the invention provides methods for producing a substantially homogenous population of polypeptides comprising an XTEN and a first and a second affinity tag and a helper sequence, the method comprising culturing in a fermentation reaction a host cell that comprises a vector encoding a polypeptide comprising an XTEN and the first and second affinity tag under conditions effective to express the polypeptide product at a concentration of more than about 10 milligrams/gram of dry weight host cell (mg/g), or at least about 15 mg/g, or at least about 20 mg/g, or at least about 25 mg/g, or at least about 30 mg/g, or at least about 40 mg/g, or at least about 50 mg/g of said polypeptide when the fermentation reaction reaches an optical density of at least 130 at a wavelength of 600 nm. In one embodiment of the foregoing, the method further comprises the steps of adsorbing the polypeptide onto a first chromatography substrate under conditions effective to capture the first affinity tag of the polypeptide onto the chromatography substrate; eluting and recovering the polypeptide; adsorbing the polypeptide onto a second chromatography substrate under conditions effective to capture the second affinity tag of the polypeptide onto the chromatography substrate; eluting the polypeptide; and recovering the substantially homogeneous polypeptide preparation. In one embodiment of the foregoing method, the vector further comprises nucleotides encoding a helper sequence at the N-terminus of the encoded polypeptide wherein the helper sequence has at least 80%, or at least 90%, or at least 95% sequence identity to a sequence set forth in Table 10. In another embodiment, the constructs of the foregoing methods of the paragraph further comprise nucleotides encoding protease cleavage sequences between the affinity tags and the XTEN and the method provides that the recovered polypeptides of the preparation are treated with a protease capable of cleaving the cleavage sequences, such as but not limited to trypsin, thereby releasing the XTEN from the polypeptide; the XTEN is adsorbed onto a chromatography substrate under conditions effective to capture the XTEN; the XTEN is then eluted and recovered as a substantially homogeneous XTEN.

TABLE 10

Examples of helper sequences to facilitate protein expression, secretion and processing in bacteria

| Amino Acid Sequence* | SEQ ID NO: | Amino Acid at Position** | | | | | |
|---|---|---|---|---|---|---|---|
| | | X1 | X2 | X3 | X4 | X5 | Z |
| ADAQKAADNKKP | 495 | | | | | | |
| KTLVYCSEGSPE | 496 | | | | | | |
| ENNAQTTNESAG | 497 | | | | | | |
| KDTIALVVSTLN | 498 | | | | | | |
| APKDNTWYTGA | 499 | | | | | | |

TABLE 10-continued

Examples of helper sequences to facilitate protein expression, secretion and processing in bacteria

| Amino Acid Sequence* | SEQ ID NO: | X1 | X2 | X3 | X4 | X5 | Z |
|---|---|---|---|---|---|---|---|
| ADVPAGVTLAEK | 500 | | | | | | |
| KIEEGKLVIWIN | 501 | | | | | | |
| AEATTAAGGA | 502 | | | | | | |
| ATGTATSEGSPE | 503 | | | | | | |
| EPTAATTGESAG | 504 | | | | | | |
| AETTAPAGST | 505 | | | | | | |
| APTEATAGTGA | 506 | | | | | | |
| AETPAGATGAE | 507 | | | | | | |
| APEEGTAGGA | 508 | | | | | | |
| SLSTEATAKIVSEFGRDAN | 509 | | | | | | |
| ANPEQLEEQREETRLIIEE | 510 | | | | | | |
| SASTEATAKAASEAGRDAN | 511 | | | | | | |
| ANPEQAEEQREETR | 512 | | | | | | |
| ANPEQAEEQREET | 513 | | | | | | |
| ANPEQAEEQSEET | 514 | | | | | | |
| KNPEQAEEQREET | 515 | | | | | | |
| KNPEQAEEQSEET | 516 | | | | | | |
| KNPEQAEEQAEEQREET | 517 | | | | | | |
| KNPEQAEEQAEEQSEET | 518 | | | | | | |
| KNHEQAEEQAEEQSEET | 519 | | | | | | |
| KKHEQAEEQAEEQSEET | 520 | | | | | | |
| KKPEQAEEQAEEQREET | 521 | | | | | | |
| KNHEQEKEKAEEQSEET | 522 | | | | | | |
| KKQEQEEKKAEEQREET | 523 | | | | | | |
| KNHEKDEKKAEEQSEET | 524 | | | | | | |
| KKQEQEKEQAEEQREET | 525 | | | | | | |
| KNPEQEKEKAEEQREET | 526 | | | | | | |
| KKPEQEEKQAEEQREET | 527 | | | | | | |
| KKQEQEKEQAEEQAESEREET | 528 | | | | | | |
| KKQEQEKEQAEEQSQSQREET | 529 | | | | | | |
| KKQEQEKEQAEEQSESEREET | 530 | | | | | | |
| KKQEQEKEQAEEQAKAESEAEREET | 531 | | | | | | |
| KKQEQEKEQAEEQSKSQAEAEREET | 532 | | | | | | |
| KKQEQEKEQAEEQAQAQAEDEREET | 533 | | | | | | |
| KKQEQEKEQAEEQSKSKAEDEREET | 534 | | | | | | |
| KKQEQEKEQAEEQPEVQREET | 535 | | | | | | |
| KKQEQEKEQAEEQVENPREET | 536 | | | | | | |

TABLE 10-continued

Examples of helper sequences to facilitate protein expression, secretion and processing in bacteria

| Amino Acid Sequence* | SEQ ID NO: | X1 | X2 | X3 | X4 | X5 | Z |
|---|---|---|---|---|---|---|---|
| KKQEQEKEQAEEQELCEREET | 537 | | | | | | |
| KKQEQEKEQAEEQG1DTREET | 538 | | | | | | |
| KNPEQAEEQX1EET | 1 | S/R | | | | | |
| ANPEQAEEQX1EET | 2 | S/R | | | | | |
| KNPEQAEEQAEEQX1EET | 3 | S/R | | | | | |
| KX2X3EQAEEQAEEQX1EET | 4 | S/R | K/N | K/N/T/Q/H/P/E/D/A/R/S | | | |
| KX2(X3)$_{10}$QX1EET | 5 | S/R | K/N | K/N/T/Q/H/P/E/D/A/R/S | | | |
| KX2(X3)$_7$AEEQX1EET | 6 | S/R | K/N | K/N/T/Q/H/P/E/D/A/R/S | | | |
| KX2X3EQE(X3)$_3$AEEQREET | 7 | | K/N | K/N/T/Q/H/P/E/D/A/R/S | | | |
| KX2X3EQE(X3)$_3$AEE(X3)$_5$ | 8 | | K/N | K/N/T/Q/H/P/E/D/A/R/S | | | |
| KKQEQEKEQAEEQ(X4X5)$_2$REET | 9 | | | | A/S | K/Q/E | |
| KKQEQEKEQAEEQ(X4X5)$_4$REET | 10 | | | | A/S | K/Q/E | |
| KKQEQEKEQAEEQ(Z)$_4$REET | 11 | | | | | | any |
| KX2(X3)$_n$, where n = 10-40 | 12 | | K/N | K/N/T/Q/H/P/E/D/A/R/S | | | |
| (X3)$_n$, where n = 10-50 | 13 | | | K/N/T/Q/H/P/E/D/A/R/S | | | |
| KX2QEQEKEQAEEQ(X4X5)$_n$X1EET, where n=0-10 | 14 | S/R | K/N | | A/S | K/Q/E | |
| KX2(X3)$_n$(X4X5)$_m$X1EET, where n = 5-20 and m = 0-10 | 15 | S/R | K/N | K/N/T/Q/H/P/E/D/A/R/S | A/S | K/Q/E | |
| KX2(X3)$_n$(Z)$_m$X1EET, where n = 5-20 and m = 0-20 | 16 | S/R | K/N | K/N/T/Q/H/P/E/D/A/R/S | | | any |

*where n or m = 0, the adjoining amino acids are contagious
**indicates the amino acid(s) that can be utilized at the given position in the amino acid sequence entries, with the alternatives separated by "/"

III). Payloads

The present invention relates in part to XTEN conjugates linked to one or more payload molecules. It is contemplated that XTEN can be linked to a broad diversity of payload molecules, including biologically active peptides, proteins, polymers, pharmacologically active small-molecules, polynucleic acids, targeting peptides and proteins, targeting small molecules, antibodies and antibody fragments, and imaging small-molecule payloads, as well as combinations of these types of payloads resulting in compositions with 2, 3, 4 or more types of payloads. The invention addresses a long-felt need in increasing the terminal half-life of exogenously administered therapeutic and diagnostic payloads to a subject in need thereof, as well as combinations of payloads that may include a therapeutic component and a targeting component.

Non-limiting examples of functional classes of pharmacologically active payload agents for use in linking to an XTEN of the invention may be any one or more of the following: hypnotics and sedatives, psychic energizers, tranquilizers, respiratory drugs, anticonvulsants, muscle relaxants, antiparkinson agents (dopamine antagonists), analgesics, anti-inflammatories, antianxiety drugs (anxiolytics), appetite suppressants, antimigraine agents, muscle contractants, anti-infectives (antibiotics, antivirals, antifungals, vaccines), antiarthritics, antimalarials, antiemetics, anepileptics, bronchodilators, coagulation factors, cytokines, chemokines, interleukins, growth factors, growth hormones, endocrine hormones, exocrine hormones, insulin, glucose-regulating peptides, anti-cancer agents, antithrombotic agents, antihypertensives, cardiovascular drugs, antiarrhythmics, antioxicants, anti-asthma agents, hormonal agents (including contraceptives), sympathomimetics, diuretics, lipid regulating agents, antiandrogenic agents, antiparasitics, anticoagulants, neoplastics, antineoplastics, hypoglycemics, nutritional agents and supplements, growth supplements, antienteritis agents, vaccines, antibodies, diagnostic agents, contrasting agents, and radioactive imaging agents.

More particularly, the active payload may fall into one of a number of structural classes, including but not limited to small molecule drugs, biologically active proteins (peptides, polypeptides, proteins, recombinant proteins, antibodies, and glycoproteins), steroids, nucleotides, oligonucleotides, polynucleotides, fats, electrolytes, and the like. For the XTEN-payload conjugation compositions, it is specifically contemplated that a payload can be a pharmacologically active agent that possesses a suitably reactive functional group, including, but not limited to a native amino group, a sulfydryl group, a carboxyl group, an aldehyde group, a ketone group, an alkene group, an alkyne group, an azide group, an alcohol group, a heterocycle, or, alternatively, is modified to contain at least one of the foregoing reactive groups suitable for coupling to either an XTEN, XTEN-cross-linker, or XTEN-click-chemistry reactant of the invention using any of the conjugation methods described herein or are otherwise known to be useful in the art for conjugating such reactive groups. Specific functional moieties and their reactivities are described in Organic Chemistry, 2nd Ed. Thomas Sorrell, University Science Books, Herndon, Va. (2005). Further, it will be understood that any payload containing a reactive group or that is modified to contain a reactive group will also contain a residue after conjugation to which either the XTEN, the XTEN-cross-linker, or the XTEN-click-chemistry reactant is linked.

Exemplary payloads suitable for covalent attachment to either an XTEN polymer, XTEN-cross-linker, or XTEN-click-chemistry reactant include biologically active proteins and pharmacologically active small molecule drugs with activity. Exemplary drugs suitable for the inventive compositions can be found as set forth in the official United States Pharmacopeia, official Homeopathic Pharmacopeia of the United States, or official National Formulary, in the Physician's Desk Reference (PDR) and in the Orange Book maintained by the U.S. Food and Drug Administration (FDA). Preferred drugs are those having the needed reactive functional group or those that can be readily derivatized to provide the reactive functional group for conjugation and will retain at least a portion of the pharmacologic activity of the unconjugated payload when conjugated to XTEN.

1. Drugs as Payloads

In some embodiments, the drug payload for conjugation to either the subject XTEN, the XTEN-cross-linkers, or the XTEN-click-chemistry reactants described herein is one or more agents described herein or selected from the payloads of Table 11, or a pharmaceutically acceptable salt, acid or derivative or agonist thereof. In one embodiment, the drug is derivatized to introduce a reactive group for conjugation to the subject XTEN, the XTEN-cross-linkers, or the XTEN-click-chemistry reactants described herein. In another embodiment, the drug for conjugation is derivatized to introduce a cleavable linker such as, but not limited to, valine-citrulline-PAB, wherein the linker is capable of being cleaved by a circulating or an intracellular protease after administration to a subject, thereby freeing the drug from the conjugate.

TABLE 11

Drugs for Conjugation to XTEN

Drugs

Erlotinib; bortezomib; Alitretinoin; Allopurinol, arsenic trioxide, clofarabine, dexrazoxane, Fulvestrant; Sutent (SU11248), Letrozole; Imatinib mesylate; PTK787/ZK 222584; Bendamustine; Romidepsin; Pralatrexate; Cabazitaxel (XRP-6258); Everolimus (RAD-001); Abirateron; Oxaliplatin; 5-FU (5-fluorouracil), leucovorin, rapamycin; lapatinib; lonafarnib; sorafenib; gefitinib; cyclosphosphamide; busulfan; improsulfan; piposulfan; benzodopa; carboquone; meturedopa; uredopa; altretamine; triethylenemelamine; triethylenephosphoramide; triethylenethiophosphoramide; trimethylomelamine; bullatacin; bullatacinone; camptothecin; topotecan; bryostatin; callystatin; CC-1065; adozelesin; calicheamycin; auristatin; monomethyl auristatin E (MMAE); monomethyl auristatin F (MMAF); (valine-citrulline-PAB)-monomethyl auristatin E; (valine-citrulline-PAB)-monomethyl auristatin F; carzelesin; bizelesin; cryptophycins (particularly cryptophycin 1 and cryptophycin 8); dolastatin; duocarmycin; eleutherobin; pancratistatin; sarcodictyin; spongistatin; chlorambucil; chlornaphazine; cholophosphamide; estramustine; ifosfamide; mechlorethamine; mechlorethamine oxide hydrochloride; melphalan, novembichin; phenesterine; prednimustine; trofosfamide; uracil mustard; carmustine; chlorozotocin; fotemustine; lomustine; nimustine; ranimnustine; calicheamicin; dynemicin; dynemicin A; clodronate; esperamicin; neocarzinostatin chromophore; aclacinomysins, actinomycin; anthramycin; azaserine; bleomycin; cactinomycin; carabicin; carminomycin; carzinophilin; chromomycinis; dactinomycin; daunorubicin; detorubicin; 6-diazo-5-oxo-L-norleucine; doxorubicin; morpholino-doxorubicin; lenalidomide, cyanomorpholino-doxorubicin; (valine-citrulline-PAB)-doxorubicin; 2-pyrrolino-doxorubicin and deoxydoxorubicin; epirubicin; esorubicin; idarubicin; marcellomycin; mitomycin C; mycophenolic acid; nogalamycin; olivomycin; peplomycin; potfiromycin; puromycin; quelamycin; rodorubicin; streptonigrin; streptozocin; tubercidin; ubenimex; zinostatin; zorubicin; 5-fluorouracil (5-FU); fdenopterin; methotrexate; pteropterin; trimetrexate; fludarabine; 6-mercaptopurine; thiamiprine; ancitabine; azacitidine; 6-azauridine; carmofur; cytarabine; dideoxyuridine; doxifluridine; enocitabine; meclorethamine, floxuridine; calusterone; dromostanolone propionate; epitiostanol; mepitiostane; testolactone; aminoglutethimide; trilostane; frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate; hydroxyurea; lentinan; lonidainine; maytansine; ansamitocins; mitoguazone; mopidanmol; nitraerine; pentostatin; phenamet; pirarubicin; losoxantrone; methoxsalen, podophyllinic acid; 2-ethylhydrazide; procarbazine; razoxane; rhizoxin; ribavirin; zidovudine; acyclovir; gangcyclovir; vidarabine; idoxuridine; trifluridine; foscarnet; amantadine; rimantadine; saquinavir; indinavir; ritonavir; alpha-interferons and other interferons; AZT; sizofuran; spirogermanium; tenuazonic acid; triaziquone; 2; 2',2''-trichlorotriethylamine; T-2 toxin; verracurin A; roridin A; anguidine); urethan; vindesine; dacarbazine; mannomustine; mitobronitol; mitolactol; pipobroman; gacytosine; arabinoside ("Ara-C"); cyclophosphamide; thiotepa; taxoids; epaclitaxel; paclitaxel; docetaxel; doxetaxel; irinotecan; pemetrexed; chloranbucil; gemcitabine; 6-thioguanine; cisplati; carboplatin; vinblastine; platinum; etoposide, VP-16; ifosfamide; mitoxantrone; novantrone, teniposide; edatrexate; daunomycin; aminopterin; xeloda; ibandronate; CPT-11; topoisomerase inhibitor RFS 2000; difluoromethylornithine (DMFO); retinoic acid; capecitabine; mesna, lidocaine; bupivacaine; memantine; quinacrine, donepezil; rivastigmine; galantamine; morphine; oxycodone; hydromorphone; oxymorphone; metopon; apomorphine; normorphine; etorphine; buprenorphine, meperidine; lopermide; anileridine; ethoheptazine; piminidine; betaprodine; diphenoxylate; fentanil; sufentanil; alfentanil; remifentanil; levorphanol; dextromethorphan; phenazocine; pentazocine; cyclazocine; methadone; isomethadone; propoxyphene; naloxone; naltrexone; treprostinil; N-methylnaloxone; 6-amino-14-hydroxy-17-allylnordesomorphine; naltrendol;, N-methylnaltrexone;

TABLE 11-continued

Drugs for Conjugation to XTEN

Drugs nalbuphine; butorphanol; cyclazocine; pentazocine,; nalmephene; naltrindole; nor-binaltorphimine; oxilorphan; 6-amino-6-desoxo-naloxone; pentazocine; levallorphanmethylnaltrexone; buprenorphine; cyclorphan; levalorphan; cyclosporine; cyclosporine A; mycophenylate mofetil; sirolimus; tacrolimus; prednisone; azathioprine; cyclophosphamide; prednisone; aminocaproic acid; chloroquine; hydroxychloroquine; dexamethasone; chlorambucil; danazol; bromocriptine; Nilotinib (AMN107); Nelarabine, amifostine, amiodarone, aminocaproic acid, aminohippurate sodium, aminoglutethimide, aminolevulinic acid, aminosalicylic acid, amsacrine, anagrelide, anastrozole, asparaginase, anthracyclines, bexarotene, bicalutamide, bleomyein, buserelin, busulfan, cabergoline, capecitabine, carboplatin, carmustine, chlorambucin, cilastatin sodium, cisplatin, cladribine, clodronate, cyclophosphamide, cyproterone, cytarabine, camptothecins, 13-cis retinoic acid, all trans retinoic acid; dacarbazine, dactinomycin, daunorubicin, deferoxamine, dexamethasone, diclofenac, diethylstilbestrol, docetaxel, doxorubicin, epirubicin, estramustine, etoposide, exemestane, fexofenadine, fludarabine, fludrocortisone, fluorouracil, fluoxymesterone, flutamide, gemcitabine, epinephrine, L-Dopa, hydroxyurea, idarubicin, ifosfamide, imatinib, irinotecan, itraconazole, goserelin acetate, letrozole, leucovorin, levamisole, lisinopril, lovothyroxine sodium, mechlorethamine, medroxyprogesterone, megestrol, melphalan, metaraminol bitartrate, metoclopramide, mexiletine, mitomycin, mitotane, naloxone, nicotine, nilutamide, octreotide, pamidronate, pilcamycin, porfimer, prednisone, prochlorperazine, ondansetron, raltitrexed, sirolimus, tacrolimus, tamoxifen, temozolomide, testosterone, tetrahydrocannabinol, thalidomide, thioguanine, topotecan, tretinoin, valrubicin, vincristine, vindesine, vinorelbine, dolasetron, granisetron; formoterol, fluticasone, leuprolide, midazolam, alprazolam, amphotericin B, podophylotoxins, nucleoside antivirals, aroyl hydrazones, sumatriptan; macrolides such as erythromycin, oleandomycin, troleandomycin, roxithromycin, clarithromycin, davercin, azithromycin, flurithromycin, dirithromycin, josamycin, spiromycin, midecamycin, leucomycin, miocamycin, rokitamycin, andazithromycin, and swinolide A; fluoroquinolones such as ciprofloxacin, ofloxacin, levofloxacin, trovafloxacin, alatrofloxacin, moxifloxicin, norfloxacin, enoxacin, grepafloxacin, sunitinib, gatifloxacin, lomefloxacin, sparfloxacin, temafloxacin, pefloxacin, amifloxacin, fleroxacin, tosufloxacin, prulifloxacin, irloxacin, pazufloxacin, clinafloxacin, and sitafloxacin; aminoglycosides such as gentamicin, netilmicin, paramecin, tobramycin, amikacin, kanamycin, neomycin, and streptomycin, vancomycin, teicoplanin, rampolanin, mideplanin, colistin, daptomycin, gramicidin, colistimethate; polymixins such as polymixin B, capreomycin, bacitracin, penems; penicillins including penicllinase-sensitive agents like penicillin G, penicillin V; penicllinase-resistant agents like methicillin, oxacillin, cloxacillin, dicloxacillin, floxacillin, nafcillin; gram negative microorganism active agents like ampicillin, amoxicillin, and hetacillin, cillin, and galampicillin; antipseudomonal penicillins like carbenicillin, ticarcillin, azlocillin, mezlocillin, and piperacillin; cephalosporins like cefpodoxime, cefprozil, ceftbuten, ceftizoxime, ceftriaxone, cephalothin, cephapirin, cephalexin, cephradrine, cefoxitin, cefamandole, cefazolin, cephaloridine, cefaclor, cefadroxil, cephaloglycin, cefuroxime, ceforanide, cefotaxime, cefatrizine, cephacetrile, cefepime, cefixime, cefonicid, cefoperazone, cefotetan, cefinetazole, ceftazidime, loracarbef, and moxalactam, monobactams like aztreonam; and carbapenems such as imipenem, meropenem, pentamidine isethiouate, albuterol sulfate, lidocaine, metaproterenol sulfate, beclomethasone diprepionate, triamcinolone acetamide, budesonide acetonide, fluticasone, ipratropium bromide, flunisolide, cromolyn sodium, and ergotamine tartrate; taxanes such as paclitaxel; SN-38, tyrphostines, 20-epi-1,25 dihydroxy vitaminD3, 5-ethynyluracil, abiraterone, Acivicin, Aclarubicin, Acodazole Hydrochloride, AcrQnine, acylfulvene, adecypenol, adramycin, Aldesleukin, ALL-TK antagonists, ambamustine, amidox, Ambomycin, Ametantrone Acetate, amrubicin, andrographolide, angiogenesis inhibitors, antagonist D, antagonist G, antarelix, anti-androgen, anti-dorselizing morphogenetic protein-1, anti-estrogen, antimetabolites, anti-neoplaston, anti-oestrogens, anti-sense oligonucleotides, anti-venom, aphidicolinglycinate, apoptosis gene modulators, apoptosis regulators, apurinic acid, ara-CDP-DL-PTBA, arginine deaminase, Asperlin, asulacrine, atamestane, atrimustine, atrsacrine, axinastatin 1, axinastatin 2, axinastatin 3, azasetron, azatoxin, azatyrosine, Azptepa: Azotomycin, baccatin III derivatives, balanol, Batimastat, BCR/ABLantagonists, benzochlorins, Benzodepa, benzoylstaurosporine, staurosporine, beta-alethine, betaclamycin B, betalactamderivatives, betamethasone, betulinic acid, bFGFinhibitor, Bicalutamide, Bisantrene Hydrochloride, bisaziridinylspermine, bisnafide, Bisnafide Dimesylate, bistratenaA, Bleomycin Sulfate, breflate, Brequinar Sodium, bromine epiandrosterone, Bropirimine, budotitane, buthionine sulfoximine, calcipotriol, calphostin C, camptothecin derivatives, canarypox IL-2, capedtabine, Caracemide, Carbetimer, carboxamide-amino-triazole: carboxyamidotriazole, CaRestM3, CARN700, cartilage derived inhibitor, Carubicin Hydrochloride, casein kinase inhibitors(ICOS), castanospermine, cecropin B, Cedefingol, cetrorelix, chlorins, chloroquinoxaline sulfonamide, , chlorotrianisene, cicaprost, Cirolemycin, cis-porphyrin, clomifene analogues, clotrimazole, collismycin A, collismycin B, combretastatin A4, combretastatin analogue, conagenin, crambescidin 816, crisnatol, Crisnatol Mesylate, cryptophycin 8, cryptophycin A derivatives, curacin A, cyclopentanthraquinones, cycloplatam, cypemycin, cytarabineocfosfate, cytolyticfactor, cytostatin, cytotoxic agents, Daunorubicin Hydrochloride, Decitabine, dehydrodidemnin B, deslorelin, dexifosfamide, Dexormaplatin, dexrmzoxane, dexverapamil, Dezaguanine, Dezaguanine Mesylate, DHEA, diaziquorie, dicarbazine, didemnin 13, didox, diethylnorspermine, dihydro-5-azacytidine: dihydrotaxol,9-, dioxamycin, diphenylspiromustine, docosanol, Doxorubicin Hydrochloride, Droloxifene, Droloxifene Citrate, Dromostanolone Propionate, dronabinol, Duazomycin, duocannycin SA, ebselen, ecorustine, edelfosine, edrocolomab, Eflomithine Hydrochloride, eflornithine, elemene, Elsamitrucin, emitefur, Enloplatin, Enpromate, epiandrosterone, Epipropidine, Epirubicin Hydrochloride, episteride, Erbulozole, erythrocyte gene therapy, Esorubicin Hydrochloride, estramustine analogue, estrogen agonists, estrogen antagonists, Etanidazole, ethinyloestradiol, Ethiodized Oil I131, Etoposide Phosphate, Etoprine, fadrozole, Fadrozole Hydrochloride, Fazarabine, fazarabine, fenretinide, Fenretinide: Floxuridine, finasteride, flavopiridol, flezelastine, Fludarabine Phosphate, fluorodaunorunicin hydrochloride, Flurocitabine, forfenimex, formestane, Fosquidone, fostriecin, Fostriecin Sodium, gadoliniumtexaphyrin, galocitabine, ganirelix, gelatinase inhibitors: gemcitabine, Gemcitabine Hydrochloride, glutathione inhibitors, Gold Au198, goserelin, hepsulfam, heregulin, hexamethylenebisacetamide, hexamethylmelamine, human chorionic gonadotrophin: monophosphoryl lipid A + myobacterium cell walls k, hypericin, ibandronic acid, Idarubicin Hydrochloride, idoxifene, idramantone, Ilmofosine, ilomastat, imidazoacridones, imiquimod, immuno stimulant peptides: insulin-like

TABLE 11-continued

Drugs for Conjugation to XTEN
Drugs growth factor-1 receptor inhibitor, interferon agonists, Interferon Alfa-2a, Interferon Alfa-2b, Interferon Alfa-n1, Interferon Alfa-n3, Interferon Beta-Ia, Interferon Gamma-Ib, iobenguane, iododoxorubicin, ipomeanol, Iproplatin, Irinotecan Hydrochloride, iroplact, irsogladine, isobengazole, isohomohalicondrin B, itasetron, jasplakinolide, kahalalide F, lamellarin-Ntriacetate, lanreotide, Lanreotide Acetate, leinamycin, lenograstim, lentinan sulfate, leptolstatin, leukemia inhibiting factor, leukocyte alpha interferon, Leuprolide Acetate, leuprolide + estrogen + progesterone, leuprorelin, liarozole, Liarozole Hydrochloride, linear polyamine analogue, lipophilic disaccharide peptide, lipophilic platinum compounds, lissoclinamide7, lobaplatin, lombricine, lometrexol, Lometrexol Sodium, lonidamine, Losoxantrone Hydrochloride, lovastatin, loxoribine, luprolide, lurtotecan, lutetlumtexaphyrin, lysofylline, lyticpeptides, maitansine, mannostatin A, marimastat, Masoprocol, maspin, matrilysin inhibitors, matrix metallo proteinase inhibitors, mecaptopurine, Mechlorethamine Hydrochloride, Megestrol Acetate, Melengestrol Acetate, Menogaril, merbarone, meterelin, methioninase, methlorethamine, Metoprine, Meturedepa, microalgal, mifepristone, MIFinhibitor, miltefosine, mirimostim, mismatched double stranded RNA, Mitindomide, Mitocarcin, Mitocromin, Mitogillin, mitoguazone, Mitomalcin, mitomycin analogues, mitonafide, Mitosper, mitotoxin fibroblast growth factor-saporin, mofarotene, molgramostim, monoclonal antibody, multiple drug resistance gene inhibitor, multiple tumor suppressor1-based therapy, mustard anticancer agent, mutamycin, mycaperoxide B, mycobacterial cell wall extract, *Mycobacterium bovis*, myriaporone, N-acetyldinaline: N-substitutedbenzamides, nafarelin, nagrestip, naloxone + pentazocine, napavin, naphterpin, nartograstim, nedaplatin, nemorubicin, neridronic acid, neutral endo peptidase, nisamycin, nitric oxide modulators, nitrogen mustard derivatives, nitroxide antioxidant, nitrullyn, Nocodazole: Nogalamycin, O6-benzylguanine, oestradiol, okicenone, oligonucleotides, onapristone: ondansetron, ondansetron, oracin, oral cytokine inducer, Ormaplatin, osaterone, oxaunomycin, Oxisuran, palauamine, palmitoylrizoxin, pamidronic acid, panaxytriol, panomifene, parabactin, pazelliptine: pegaspargase, Pegaspargase, peldesine: pentosanpolysulfatesodium, Peliomycin, Pentamustine, pentrozole, Peplomycin Sulfate, perflubron, Perfosfamide, perillyl alcohol, phenazinomycin, phenylacetate, phosphatase inhibitors, picibanil, pilocarpine hydrochloride, piritrexim, Piroxantrone Hydrochloride, placetin A, placetin B, plasminogen activator inhibitor, platinum complex, platinum compounds, platinum-triamine complex, Plicamycin, Plomestane, Porfimer Sodium, Procarbazine Hydrochloride, propylbis-acridone, prostaglandin J2, prostatic carcinoma, proteasome inhibitors, protein A-based immune modulator, protein kinase C inhibitor, protein tyrosine phosphatase inhibitors, purine nucleoside phosphorylase inhibitors, Puromycin Hydrochloride, purpurins, Pyrazofurin, pyrazoloacridine, pyridoxylated hemoglobin polyoxyethylene conjugate, raf antagonists, ramosetron, rasfarnesyl protein transferase inhibitors, ras inhibitors: ras-GAP inhibitor, retelliptine demethylated, rhenium Re186 etidronate, Riboprine, ribozymes, RII retinamide, RM-131 (ghrelin agonist), RM-493 (agonis for melanocortin type 4 receptor), Rogletimide, rohitumine, romurtide, roquinimex, rubiginone B1, ruboxyl, Safingol Hydrochloride, Safingol, saintopin: Sar CNU, sarcophytol A, sargramostim, Sdi1 mimetics, Semustine, senescence derived inhibitor 1, sense oligonucleotides, signal transduction inhibitors, signal transduction modulators, Simtrazene, single chain antigen binding protein, sobuzoxane, sodium borocaptate, sodium phenylacetate, solverol, somatomedin binding protein, sonermin, Sparfosate Sodium, sparfosic acid, Sparsomycin, Spirogermanium Hydrochloride, Spiromustine, spiromustine: splenopentin, Spiroplatin, splcamycin D, squalamine, stem cell inhibitor, stem-cell division inhibitors, stipiamide, stromelysin inhibitors, Strontium Chloride Sr89, sulfmosine, Sulofenur, superactive vasoactive intestinal peptide antagonist, suradista, suramin, swainsonine, synthetic glycosamino glycans, Talisomycin, tallimustine, tamoxifen methiodide, tauromustine, tazarotene, Tecogalan Sodium, Tegafur, tellurapyrylium, telnoporfin, telomerase inhibitors, Teloxantrone Hydrochloride, Temoporfin, ternozolomide, Teroxirone, tetrachlorodecaoxide, tetrazomine, texotere, thallblastine, thiocoraline, thrombopoietin mimetic, thymalfasin, thymopoietin receptor agonist, thymotrinan, thyroid stimulating hormone, Tiazofurin, tinethylotiopurpurin, Tirapazamine, titanocene dichloride, Topotecan Hydrochloride, topsentin, toremifene, Toremifene Citrate, totipotent stem cell factor, translation inhibitors, Trestolone Acetate, triacetyluridine, triciribine, Triciribine Phosphate: Trimetrexate, Trimetrexate Glucuronate, Triptorelin, triptorelin: tropisetron, tubulozole hydrochloride, turosteride, tyrosine kinase inhibitors, UBC inhibitors, urodepa, urogenital sinus-derived growth inhibitory factor, urokinase receptor antagonists, vapreotide, variolin B, vector system, velaresol, venom, veramine, verdins, Verleporfin, verteporfin, Vinblastine Sulfate, vincristine sulfate, vindesine, Vindesine Sulfate, Vinepidine Sulfate, Vinglycinate Sulfate, Vinleurosine Sulfate, vinorelbine tartrate, vinrosidine sulfate, vinxaltine, Vinzolidine Sulfate, vitaxin, Vorozole, zanoterone, Zeniplatin, zilascorb, zinostatin stimalamer, Zorubicin Hydrochloride, Bovine pancreatic RNase, Human pancreatic RNAse, Mammalian pancreatic RNase, onconase, ranpirnase, pokeweed antiviral protein, rachelmycin, ricin-A chain, gelonin, everolimus, carfilzomib, tubulysin, tubulysin B, tubulysin M, maytansinoid DM1, maytansinoid DM4, triptolide, SJG-136, apaziquone, irofulven, illudin S, tomaymycin, zoledronate

2. Biologically Active Proteins as Payloads

In another aspect, the invention provides XTEN-payload compositions in which the payload is a biologically active protein, either as a peptide or polypeptide. In some embodiments of XTEN-payload conjugates, the payload is any pharmacologically active peptide or polypeptide that can be expressed recombinantly as a fusion protein linked to one or more XTEN. In other embodiments of XTEN-payload conjugates, the payload is any pharmacologically active peptide or polypeptide that can be conjugated to one or more XTEN. The conjugates may be in a configuration as described herein, below. The exemplary peptide or polypeptide payloads are meant to encompass analogs, agonists, antagonists, inhibitors, and isomers. It will be understood that the subject peptides and proteins encompass synthetic, semi-synthetic, recombinant, native, glycosylated, and non-glycosylated forms, as well as biologically active fragments, sequence variants, species variants, homologs and mutations thereof as long as the resulting variant protein retains a portion of activity of the parent or native protein.

Biologically active protein sequences can be obtained from publicly available databases, patents, or literature references and other such sources that are well known in the art. For example, sequences can be obtained from Universal Protein Resource (UniProt)/Swiss-Prot, European Bioinformatics Institute (EBI), the SIB Swiss Institute of Bioinformatics, the Protein Information Resource (PIR). Chemical Abstracts Services (CAS) Registry Numbers (published by the American Chemical Society) and/or GenBank Accession Numbers (e.g., AAA-AZZ, HAA-HZZ, JAA-JZZ), Model Protein identifiers available through the National Center for Biotechnology Information (NCBI) webpage, available on the world wide web at ncbi.nlm.nih.gov that correspond to entries in the CAS Registry or GenBank database that contain an amino acid sequence of the protein of interest or of a fragment or variant of the protein. For such sequence identifiers provided herein, the summary pages associated with each of these CAS and GenBank and GenSeq Accession Numbers as well as the cited journal publications (e.g., PubMed ID number (PMID)) are each incorporated by reference in their entireties, particularly with respect to the amino acid sequences described therein.

In one embodiment, the XTEN-payload composition, whether in recombinant or conjugate form, comprises one or more molecules of a biologically active peptide or protein that includes, but is not limited to a peptide or polypeptide selected from the payloads set forth in Table 12, or a sequence variant thereof that retains at least a portion of the activity of the biologically active protein. By "sequence variant," it is meant that the biologically active protein exhibits at least about 80%, or 90%, or 91%, or 92%, or 93%, or 94%, or 95%, or 96%, or 97%, or 98%, or 99% sequence identity, when optimally aligned, to that of the known peptide or polypeptide, such as are listed in Table 12.

TABLE 12

Biologically Active Proteins for linking to XTEN
Protein/Peptide Name

EPO, IFN-α, IFN-β, IFN-γ, consensus IFN, factor VII, factor VIII, factor IX, IL-1, IL-2, remicade (infliximab), Rituxan (rituximab), Enbrel (etanercept), Synagis (palivizumab), Reopro (abciximab), Herceptin (trastuzimab), tPA, Cerizyme (imiglucerase), Hepatitus-B vaccine, rDNAse, alpha-1 proteinase inhibitor, C-peptide, fuzeon, G-CSF, GM-CSF, growth hormone, somatropin, growth hormone releasing hormone, insulin, insulin analogues, glucagon, GLP-1, GLP-2, FSH, TNF-receptor, uricase, VEGF, PTH, aspariginase, amdoxovir (DAPD), antide, becaplermin, calcitonins, cyanovirin, denileukin diftitox, erythropoietin (EPO), ceredase, cerezyme, alpha-glucosidase, collagen, cyclosporin, alpha defensins, beta defensins, exendin-4, granulocyte colony stimulating factor (GCSF), thrombopoietin (TPO), alpha-1 proteinase inhibitor, elcatonin, granulocyte macrophage colony stimulating factor (GMCSF), fibrinogen, filgrastim, growth hormones human growth hormone (hGH), growth hormone releasing hormone (GHRH), GRO-beta, GRO-beta antibody, bone morphogenic proteins such as bone morphogenic protein-2, bone morphogenic protein-6, OP-1; acidic fibroblast growth factor, basic fibroblast growth factor, CD-40 ligand, heparin, human serum albumin, low molecular weight heparin (LMWH), interferons such as interferon alpha, interferon beta, interferon gamma, interferon omega, interferon tau, consensus interferon; interleukins and interleukin receptors such as interleukin-1 receptor, interleukin-2, interluekin-2 fusion proteins, interleukin-1 receptor antagonist, interleukin-3, interleukin-4, interleukin-4 receptor, interleukin-6, interleukin-8, interleukin-12, interleukin-13 receptor, interleukin-17 receptor; lactoferrin and lactoferrin fragments, luteinizing hormone releasing hormone (LHRH), insulin, pro-insulin, insulin analogues (e.g., mono-acylated insulin as described in U.S. Pat. No. 5,922,675), amylin, somatostatin, somatostatin analogs including octreotide, vasopressin, follicle stimulating hormone (FSH), influenza vaccine, insulin-like growth factor (IGF), insulintropin, macrophage colony stimulating factor (M-CSF), plasminogen activators such as alteplase, urokinase, reteplase, streptokinase, pamiteplase, lanoteplase, and teneteplase; nerve growth factor (NGF), osteoprotegerin, platelet-derived growth factor, tissue growth factors, transforming growth factor-1, vascular endothelial growth factor, leukemia inhibiting factor, keratinocyte growth factor (KGF), glial growth factor (GGF), T Cell receptors, CD molecules/antigens, tumor necrosis factor (TNF), monocyte chemoattractant protein-1, endothelial growth factors, parathyroid hormone (PTH), thymosin alpha 1, thymosin alpha 1 IIb/IIIa inhibitor, thymosin beta 10, thymosin beta 9, thymosin beta 4, alpha-1 antitrypsin, phosphodiesterase (PDE) compounds, VLA-4 (very late antigen-4), VLA-4 inhibitors, bisphosponates, respiratory syncytial virus antibody, cystic fibrosis transmembrane regulator (CFTR) gene, deoxyreibonuclease (Dnase), bactericidal/permeability increasing protein (BPI), anti-CMV antibody, etanercept, abciximab, afeliomomab, basiliximab, daclizumab, infliximab, ibritumomab tiuexetan, mitumomab, muromonab-CD3, iodine 131 tositumomab conjugate, olizumab, rituximab, trastuzumab (herceptin), boxtox, Dysport, alglucosidase alfa, daptomycin, YH-16, choriogonadotropin alfa, filgrastim, cetrorelix, interleukin-2, aldesleukin, teceleukin, denileukin diftitox, interferon alfa-n3 (injection), interferon alfa-n1, DL-8234, interferon, Suntory (gamma-1a), interferon gamma, thymosin alpha 1, tasonermin, DigiFab, ViperaTAb, EchiTAb, CroFab, nesiritide, abatacept, alefacept, Rebif, eptotermin alfa, teriparatide (osteoporosis), calcitonin injectable, bone disease), calcitonin (nasal, osteoporosis), etanercept, hemoglobin glutamer 250 (bovine), drotrecogin alfa, collagenase, carperitide, recombinant human epidermal growth factor (topical gel, wound healing), DWP-401, darbepoetin alfa, epoetin omega, epoetin beta, epoetin alfa, desirudin, lepirudin, bivalirudin, nonacog alpha, Mononine, eptacog alfa (activated), recombinant Factor VIII + VWF, Recombinate, recombinant Factor VIII, Factor VIII (recombinant), Alphanate, octocog alfa, Factor VIII, palifermin, Indikinase, tenecteplase, alteplase, pamiteplase, reteplase, nateplase, monteplase, follitropin alfa, rFSH, hpFSH, micafungin, pegfilgrastim, lenograstim, nartograstim, sermorelin, glucagon, exenatide, pramlintide, imiglucerase, galsulfase, Leucotropin, molgramostim, triptorelin acetate, histrelin, histrelin acetate, deslorelin, nafarelin, leuprolide sustained release depot (ATRIGEL), leuprolide implant (DUROS), somatropin, Eutropin, KP-102 program, somatropin, somatropin, mecasermin (growth failure), enfuvirtide, Org-33408, insulin glargine, insulin glulisine, insulin (inhaled), insulin lispro, insulin detemir, insulin (buccal, RapidMist), mecasermin rinfabate, anakinra, celmoleukin, 99mTc-apcitide injection, myelopid, Betaseron, glatiramer acetate, Gepon, oprelvekin, human leukocyte-derived alpha interferons, Bilive, insulin (recombinant), recombinant human insulin, insulin aspart, mecasermin, Roferon-A, interferon-alpha 2, Alfaferone, interferon alfacon-1, interferon alpha, Avonex' recombinant human luteinizing hormone, dornase alfa, trafermin, ziconotide, taltirelin, dibotermin alfa, atosiban, becaplermin, eptifibatide, Zemaira, CTC-111, Shanvac-B, HPV vaccine (quadrivalent), NOV-002, octreotide, lanreotide, ancestim, agalsidase beta, agalsidase alfa, laronidase, prezatide copper acetate (topical gel), rasburicase, ranibizumab, Actimmune, PEG-Intron, Tricomin, recombinant house dust mite allergy desensitization injection,

TABLE 12-continued

Biologically Active Proteins for linking to XTEN
Protein/Peptide Name recombinant human parathyroid hormone (PTH) 1-84 (sc, osteoporosis), epoetin delta, transgenic antithrombin III, Granditropin, Vitrase, recombinant insulin, interferon-alpha (oral lozenge), GEM-21S, vapreotide, idursulfase, omapatrilat, recombinant serum albumin, certolizumab pegol, glucarpidase, human recombinant C1 esterase inhibitor (angioedema), lanoteplase, recombinant human growth hormone, enfuvirtide (needle-free injection, Biojector 2000), VGV-1, interferon (alpha), lucinactant, aviptadil (inhaled, pulmonary disease), icatibant, ecallantide, omiganan, Aurograb, pexiganan acetate, ADI-PEG-20, LDI-200, degarelix, cintredekin besudotox, FavId, MDX-1379, ISAtx-247, liraglutide, teriparatide (osteoporosis), tifacogin, AA-4500, T4N5 liposome lotion, catumaxomab, DWP-413, ART-123, Chrysalin, desmoteplase, amediplase, corifollitropin alpha, TH-9507, teduglutide, Diamyd, DWP-412, growth hormone (sustained release injection), recombinant G-CSF, insulin (inhaled, AIR), insulin (inhaled, Technosphere), insulin (inhaled, AERx), RGN-303, DiaPep277, interferon beta (hepatitis C viral infection (HCV)), interferon alfa-n3 (oral), belatacept, transdermal insulin patches, AMG-531, MBP-8298, Xerecept, opebacan, AIDSVAX, GV-1001, LymphoScan, ranpirnase, Lipoxysan, lusupultide, MP52 (beta-tricalciumphosphate carrier, bone regeneration), melanoma vaccine, sipuleucel-T, CTP-37, Insegia, vitespen, human thrombin (frozen, surgical bleeding), thrombin, TransMID, alfimeprase, Puricase, terlipressin, EUR-1008M, recombinant FGF-1, BDM-E, rotigaptide, ETC-216, P-113, MBI-594AN, duramycin (inhaled, cystic fibrosis), SCV-07, OPI-45, Endostatin, Angiostatin, ABT-510, Bowman Birk Inhibitor Concentrate, XMP-629, 99mTc-Hynic-Annexin V, kahalalide F, CTCE-9908, teverelix (extended release), ozarelix, romidepsin, BAY-50-4798, interleukin-4, PRX-321, Pepscan, iboctadekin, rh lactoferrin, TRU-015, IL-21, ATN-161, cilengitide, Albuferon, Biphasix, IRX-2, omega interferon, PCK-3145, CAP-232, pasireotide, huN901-DM1, ovarian cancer immunotherapeutic vaccine, SB-249553, Oncovax-CL, OncoVax-P, BLP-25, CerVax-16, nemifitide, rAAT (inhaled), rAAT (dermatological), CGRP (inhaled, asthma), pegsunercept, thymosin beta-4, plitidepsin, GTP-200, ramoplanin, GRASPA, OBI-1, AC-100, salmon calcitonin (oral, eligen), calcitonin (oral, osteoporosis), examorelin, capromorelin, Cardeva, velafermin, 131I-TM-601, KK-220, TP-10, ularitide, depelestat, hematide, Chrysalin (topical), rNAPc2, recombinant Factor VIII (PEGylated liposomal), bFGF, PEGylated recombinant staphylokinase variant, V-10153, SonoLysis Prolyse, NeuroVax, CZEN-002, islet cell neogenesis therapy, rGLP-1, BIM-51077, LY-548806, exenatide, AVE-0010, GA-GCB, avorelin, AOD-9604, linaclotide acetate, CETi-1, Hemospan, VAL (injectable), insulin, recombinant methionyl human leptin, pitrakinra subcutaneous injection, eczema), pitrakinra (inhaled dry powder, asthma), Multikine, RG-1068, MM-093, NBI-6024, AT-001, PI-0824, Org-39141, Cpn10 (autoimmune iseases/inflammation), talactoferrin (topical), rEV-131 (ophthalmic), rEV-131 (respiratory disease), oral recombinant human insulin (diabetes), RPI-78M, CYT-99007 CTLA4-Ig, DTY-001, valategrast, interferon alfa-n3 (topical), IRX-3, RDP-58, Tauferon, bile salt stimulated lipase, Merispase, alkaline phosphatase, EP-2104R, Melanotan-II, bremelanotide, ATL-104, recombinant human microplasmin, AX-200, SEMAX, ACV-1, Xen-2174, CJC-1008, dynorphin A, SI-6603, LAB GHRH, AER-002, BGC-728, malaria vaccine (virosomes, PeviPRO), ALTU-135, parvovirus B19 vaccine, influenza vaccine (recombinant neuraminidase), malaria/HBV vaccine, anthrax vaccine, Vacc-5q, Vacc-4x, HIV vaccine (oral), HPV vaccine, Tat Toxoid, YSPSL, CHS-13340, PTH(1-34) liposomal cream (Novasome), Ostabolin-C, PTH analog (topical, psoriasis), MBRI-93.02, MTB72F vaccine (tuberculosis), MVA-Ag85A vaccine (tuberculosis), FAR-404, BA-210, recombinant plague F1V vaccine, AG-702, OxSODrol, rBetV1, Der-p1/Der-p2/Der-p7 allergen-targeting vaccine (dust mite allergy), PR1 peptide antigen (leukemia), mutant ras vaccine, HPV-16 E7 lipopeptide vaccine, labyrinthin vaccine (adenocarcinoma), CML vaccine, WT1-peptide vaccine (cancer), IDD-5, CDX-110, Pentrys, Norelin, CytoFab, P-9808, VT-111, icrocaptide, telbermin, rupintrivir, reticulose, rGRF, P1A, alpha-galactosidase A, ACE-011, ALTU-140, CGX-1160, angiotensin therapeutic vaccine, D-4F, ETC-642, APP-018, rhMBL, SCV-07 (oral, tuberculosis), DRF-7295, ABT-828, ErbB2-specific immunotoxin (anticancer), DT388IL-3, TST-10088, PRO-1762, Combotox, cholecystokinin-B/gastrin-receptor binding peptides, 111In-hEGF, AE-37, trastuzumab-DM1, Antagonist G, IL-12 (recombinant), PM-02734, IMP-321, rhIGF-BP3, BLX-883, CUV-1647 (topical), L-19 based radioimmunotherapeutics (cancer), Re-188-P-2045, AMG-386, DC/I540/KLH vaccine (cancer), VX-001, AVE-9633, AC-9301, NY-ESO-1 vaccine (peptides), NA17.A2 peptides, melanoma vaccine (pulsed antigen therapeutic), prostate cancer vaccine, CBP-501, recombinant human lactoferrin (dry eye), FX-06, AP-214, WAP-8294A2 (injectable), ACP-HIP, SUN-11031, peptide YY [3-36] (obesity, intranasal), FGLL, atacicept, BR3-Fc, BN-003, BA-058, human parathyroid hormone 1-34 (nasal, osteoporosis), F-18-CCR1, AT-1001 (celiac disease/diabetes), JPD-003, PTH(7-34) liposomal cream (Novasome), duramycin, CAB-2, CTCE-0214, erythropoietin, EPO-Fc, CNTO-528, AMG-114, JR-013, Factor XIII, aminocandin, PN-951, 716155, SUN-E7001, TH-0318, BAY-73-7977, teverelix (immediate release), EP-51216, hGH, OGP-I, sifuvirtide, TV-4710, ALG-889, Org-41259, rhCC10, F-991, thymopentin (pulmonary diseases), r(m)CRP, hepatoselective insulin, subalin, L19-IL-2 fusion protein, elafin, NMK-150, ALTU-139, EN-122004, rhTPO, thrombopoietin receptor agonist, AL-108, AL-208, nerve growth factor antagonists (pain), SLV-317, CGX-1007, INNO-105, oral teriparatide (eligen), GEM-OS1, AC-162352, PRX-302, LFn-p24 fusion vaccine (Therapore), EP-1043, hPTH(1-34), 768974, SYN-101, PGN-0052, aviscumine, BIM-23190, enkastim, APC-8024, GI-5005, ACC-001, TTS-CD3, TNF, desmopressin, onercept, TP-9201, AC165198, Activin receptor type IIA, Adenosine deaminase, Adipotide, Afostase alfa (alkaline phosphatase), Alpha melanocyte stimulating hormone, Alpha-1 antitrypsin, Alpha-galactosidase, Angiotensin, Anti-angiopoietin-1 inhibitor, Anti-angiopoietin-2 inhibitor, Apolipoprotein A1, Arcalyst, Arginine deiminase, Asparaginase, Atilmotin, AZD2820, Bradykinin receptor antagonist, Calcitonin, Calcitonin gene-related peptide, Cenderitide, Cholecystokinin, Ciliary neurotropic factor (CNTF), Ciligenitide, Coagulation factor IX, Coagulation factor VII, Coagulation factor VIII, Coagulation factor X, Coagulation factor XIII, Collagenase, Complement C1 esterase inhibitor (conestat alfa), Complement factor C3 inhibitor, Complement factor C5 inhibitor, Corticotropin-releasing factor, C-peptide, C-type natriuretic peptide, Defensins, DiaPep277, Diphenhydramine, Ecallantide, Endostatin, Eptifibatide, Fibrinogen, Fibroblast growth factor receptor agonist, Follicle-stimulating hormone (FSH), Follistatin, FP-1039 (FGF trap), Fuzeon, Gastrin, Ghrelin, Ghrelin antagonist, GIP-1, GIP-1/GLP-1 dual agonist, Glucagon, Glucagon-like peptide (GLP) 1, TABLE 12-continued Biologically Active Proteins for linking to XTEN
Protein/Peptide Name Glucagon-like peptide (GLP) 2, Glucocerebrosidase (Cerezyme), Glutamate carboxypeptidase (carboxypeptidase G2), Glutaminase, Granulocyte colony stimulating factor (GCSF), Growth hormone, Growth hormone releasing hormone (GHRH), Hematide, Heparinase, Hirudin, Human chorionic gonadotropin (hCG), Human deoxyribonuclease I, Humanin, Hyaluronidase, Icatibant, Iduronate-2-sulfatase (Elaprase), INGAP (Exsulin), Insulin, Irisin, KAI-4169, Lepirudin (Refludan), Leukemia inhibiting factor, L-iduronidase, LRP5 inhibitor, LRP6 inhibitor, Luteinizing hormone (LH), Macrophage inflammatory protein 2 (GroBeta-T CXC chemokine), Mannose binding lectin, Melanocortin stimulating hormone, Methioninase (METase), Mirostipen, MUCl inhibitor, Myostatin inhibitor, N-acetylgalactosamine 4-sulfatase (Naglazyme), Nerve growth factor (Cerebrolysin), Neuropeptide Y2, Neurophilin, NU206, Onconase (Ranpirnase), Ontak (IL-2-toxin), Opioid growth factor, Oxyntomodulin, Oxytocin, Paliperidone, Pancreatic polypeptide, PanCyte, Parathyroid hormone (PTH), Parathyroid hormone related protein (PTHrP), Peptide YY (3-36), Phenylalanine ammonia lyase (PAL), Phenylalanine hydroxylase(PAH), Pituitary adenylate cyclase-activating polypeptide (PACAP), Platelet-activating factor acetylhydrolase, POT-4 (APL-1), Pramlintide, P-Selectin, Relaxin, rhDNase (Pulmozyme), RNase, Sanvar, Secretin, SN38, Somatostatin (Octreotide, Pasireotide, Sandostatin etc.), Somavert (human growth hormone receptor antagonist), Stem cell growth factor, Superoxide dismutase, TACI, Thrombin inhibitor (direct), Thrombomodulin, Thrombopoietin (TPO), Thymosin alpha 1 (Thymalfasin), Thyroid stimulating hormone (TSH), Thyrotropin releasing hormone, Tigapotide, Tissue plasminogen activator (tPA), TLN-232, Tripeptidyl peptidase 1, Tumour necrosis factor receptor, Tyrosine kinase receptor (TrkA), UGP281, Urate oxidase, Uricase, Urocortin 2, Urokinase plasminogen activator, Vascular endothelial growth factor (VEGF) inhibitor, Vasoactive intestinal peptide, Vasopressin, von Willebrand Factor (vWF), Ziconotide (Prialt), Zinc protoporphyrin, Adrenal corticotrophin hormone (ACTH), CD25, Interleukin-1 receptor, Interleukin-21, ABCF1, ACVR1, ACVR1B, ACVR2, ACVR2B, ACVRL1, ADORA2A, Aggrecan, AGR2, AICDA, AIF1, AIG1, AKAP1, AKAP2, AMH, AMHR2, ANGPT1, ANGPT2, ANGPTL3, ANGPTL4, ANPEP, APC, APOC1, APRIL, AR, AZGP1 (zinc-a-glycoprotein), A4 integrin, B7, B7.1, B7.2, BAD, BAFF, BAG1, BAI1, BCL2, BCL6, BDNF, BLNK, BLR1 (MDR15), BlyS, BMP1, BMP2, BMP3B (GDF10), BMP4, BMP6, BMP8, BMPR1A, BMPR1B, BMPR2, BPAG1 (plectin), BRCA1, C19orf10 (IL27w), C3, C4A, C5, C5R1, CANT1, CASP1, CASP4, CAV1, CCBP2 (D6/JAB61), CCL1 (1-309), CCL11 (eotaxin), CCL13 (MCP-4), CCL15 (MIP-1d), CCL16 (HCC-4), CCL17 (TARC), CCL18 (PARC), CCL19 (MIP-3b), CCL2 (MCP-1), MCAF, CCL20 (MIP-3a), CCL21 (MIP-2), SLC, exodus-2, CCL22 (MDC/STC-1), CCL23 (MPIF-1), CCL24 (MPIF-2/eotaxin-2), CCL25 (TECK), CCL26 (eotaxin-3), CCL27 (CTACK/ILC), CCL28, CCL3 (MIP-1a), CCL4 (MIP-1b), CCL5 (RANTES), CCL7 (MCP-3), CCL8 (mcp-2), CCNA1, CCNA2, CCND1, CCNE1, CCNE2, CCR1 (CKR1/HM145), CCR2 (mcp-1RB/RA), CCR3 (CKR3/CMKBR3), CCR4, CCR5 (CMKBR5/ChemR13), CCR6 (CMKBR6/CKR-L3/STRL22/DRY6), CCR7 (CKR7/EBI1), CCR8 (CMKBR8/TER1/CKR-L1), CCR9 (GPR-9-6), CCRL1 (VSHK1), CCRL2 (L-CCR), CD164, CD19, CD1C, CD20, CD200, CD-22, CD24, CD28, CD3, CD37, CD38, CD3E, CD3G, CD3Z, CD4, CD11a (LFA-1 integrin alphaL), CD40, CD40L, CD44, CD45RB, CD52, CD69, CD72, CD74, CD79A, CD79B, CD8, CD80, CD81, CD83, CD86, CD340, CDH1 (E-cadherin), CDH10, CDH12, CDH13, CDH18, CDH19, CDH20, CDH5, CDH7, CDH8, CDH9, CDK2, CDK3, CDK4, CDK5, CDK6, CDK7, CDK9, CDKN1A (p21Wap1/Cip1), CDKN1B (p27Kip1), CDKN1C, CDKN2A (p16INK4a), CDKN2B, CDKN2C, CDKN3, CEBPB, CER1, CHGA, CHGB, Chitinase, CHST10, CKLFSF2, CKLFSF3, CKLFSF4, CKLFSF5, CKLFSF6, CKLFSF7, CKLFSF8; CLDN3; CLDN7 (claudin-7); CLN3; CLU (clusterin); cMET; CMKLR1; CMKOR1 (RDC1); CNR1; COL18A1; COL1A1; COL4A3; COL6A1; CR2; CRP; CSF1 (M-CSF); CSF2 (GM-CSF); CSF3 (GCSF); CTLA4; CTNNB1 (b-catenin); CTSB (cathepsin B); CX3CL1 (SCYD1); CX3CR1 (V28); CXCL1 (GRO1); CXCL10(IP-10); CXCL11 (I-TAC/IP-9); CXCL12 (SDF1); CXCL13; CXCL14; CXCL16; CXCL2 (GRO2); CXCL3 (GRO3); CXCL5 (ENA-78/LIX); CXCL6 (GCP-2); CXCL9 (MIG); CXCR3 (GPR9/CKR-L2); CXCR4; CXCR6 (TYMSTR/STRL33/Bonzo); CYB5; CYC1; CYSLTR1; DAB2IP; DES; DKFZp451J0118; DNCL1; DPP4; E2F1; ECGF1; EDG1; EFNA1; EFNA3; EFNB2; EGF; EGFR; ELAC2; elastase; ENG; ENO1; ENO2; ENO3; EPHB4; EPO; ERBB-2 (Her2); EREG; ERK8; ESR1; ESR2; F3 (TF); FADD; FasL; FASN; FCER1A; FCER2; FCGR3A; FGF; FGF1 (aFGF); FGF10; FGF11; FGF12; FGF12B; FGF13; FGF14; FGF16; FGF17; FGF18; FGF19; FGF2 (bFGF); FGF20; FGF21; FGF22; FGF23; FGF3 (int-2); FGF4 (HST); FGF5; FGF6 (HST-2); FGF7 (KGF); FGF8; FGF9; FGFR3; FIGF (VEGFD); FIL1 (EPSILON); FIL1 (ZETA); FLJ12584; FLJ25530; FLRT1 (fibronectin); FLT1; FOS; FOSL1 (FRA-1); FY (DARC); GABRP (GABAa); GAGEB1; GAGEC1; GALNAC4S-6ST; GATA3; GDF5; GFI1; GGT1; GM-CSF; GNAS1; GNRH1; GPR2 (CCR10); GPR31; GPR44; GPR81 (FKSG80); GRCC10 (C10); GRP; GSN (Gelsolin); GSTP1; HAVCR2; HDAC4; HDAC5; HDAC7A; HDAC9; HER2; HGF; HIF1A; HIP1; histamine and histamine receptors; HLA-A; HLA-DRA; HM74; HMOX1; HUMCYT2A; ICEBERG; ICOSL; ID2; IFN-a; IFNA1; IFNA2; IFNA4; IFNA5; IFNA6; IFNA7; IFNB1; IFNgamma; IFNW1; IGBP1; IGF1; IGF1R; IGF2; IGFBP2; IGFBP3; IGFBP6; IL-1; IL10; IL10RA; IL10RB; IL11; IL11RA; IL-12; IL12A; IL12B; IL12RB1; IL12RB2; IL13; IL13RA1; IL13RA2; IL14; IL15; IL15RA; IL16; IL17; IL17B; IL17C; IL17R; IL18; IL18BP; IL18R1; IL18RAP; IL19; IL1A; IL1B; IL1F10; IL1F5; IL1F6; IL1F7; IL1F8; IL1F9; IL1HY1; IL1R1; IL1R2; IL1RAP; IL1RAPL1; IL1RAPL2; IL1RL1; IL1RL2; IL1RN; IL2; IL20; IL20RA; IL21R; IL22; IL22RA; IL22RA2; IL23; IL24; IL25; IL26; IL27; IL28A; IL28B; IL29; IL2RA; IL2RB; IL2RG; IL3; IL30; IL3RA; IL4; IL4R; IL5; IL5RA; IL6; IL6R; IL6ST (glycoprotein 130); IL7; IL7R; IL8; IL8RA; IL8RB; IL8RB; IL9; IL9R; ILK; INHA; INHBA; INSL3; INSL4; IRAK1; IRAK2; ITGA1; ITGA2; ITGA3; ITGA6 (a6 integrin); ITGAV; ITGB3; ITGB4 (b 4 integrin); JAG1; JAK1; JAK3; JUN; K6HF; KAI1; KDR; KITLG; KLF5 (GC Box BP); KLF6; KLK10; KLK12; KLK13; KLK14; KLK15; KLK3; KLK4; KLK5; KLK6; KLK9; KRT1; KRT19 (Keratin 19); KRT2A; KRTHB6 (hair-specific type II keratin); LAMA5; LEP (leptin); LFA3; LIGHT; Lingo-p75; Lingo-Troy; LPS; LTA (TNF-b); LTB; LTB4R (GPR16); LTB4R2; LTBR; MACMARCKS; MAG or Omgp; MAP2K7 (c-Jun); MDK; MIB1; midkine; MIF; MIP-2; MKI67 (Ki-67); MMP2; MMP9; MS4A1; MSMB; MT3 (metallothionectin-III); MTSS1; MUC1 (mucin); MYC; MYD88; NCK2; neurocan; NFKB1; NFKB2; NGFB (NGF); NGFR; NgR-Lingo; NgR-Nogo66 (Nogo); NgR-p75; NgR-Troy; NME1 (NM23A); NOX5; NPPB; NR0B1; NR0B2; NR1D1; NR1D2; NR1H2; NR1H3; NR1H4; NRII2; NRII3; NR2C1; NR2C2; NR2E1; NR2E3; NR2F1; NR2F2; NR2F6; NR3C1; NR3C2; NR4A1; NR4A2; NR4A3; NR5A1; NR5A2; NR6A1; NRP1; NRP2; NT5E; NTN4; ODZ1;

TABLE 12-continued

Biologically Active Proteins for linking to XTEN
Protein/Peptide Name

OPRD1; P2RX7; PAP; PARTI; PATE; PAWR; PCA3; PCNA; PDGFA; PDGFB; PECAM1; PF4
(CXCL4); PGF; PGR; phosphacan; PIAS2; PIK3CG; PLAU (uPA); PLG; PLXDC1; PPBP (CXCL7);
PPID; PR1; PRKCQ; PRKD1; PRL; PROC; PROK2; PSAP; PSCA; PTAFR; PTEN; PTGS2 (COX-2);
PTN; RAC2 (p21Rac2); RANKL; RARB; RGS1; RGS13; RGS3; RNF110 (ZNF144); ROBO2; RSV;
SI00A2; SCGB1D2 (lipophilin B); SCGB2A1 (mammaglobin B); SCGB2A2 (mammaglobin 1); SCYE1
(endothelial Monocyte-activating cytokine); SDF2; SERPINA1; SERPINA3; SERPINB5 (maspin);
SERPINE1 (PAI-1); SERPINF1; SHBG; SLA2; SLC2A2; SLC33A1; SLC43A1; SLIT2; SPP1; SPRR1B
(Spr1); ST6GAL1; STAB1; STAT6; STEAP; STEAP2; TB4R2; TBX21; TCP10; TDGF1; TEK; TGFA;
TGFB1; TGFB111; TGFB2; TGFB3; TGFBI; TGFBR1; TGFBR2; TGFBR3; TH1L; THBS1
(thrombospondin-1); THBS2; THBS4; THPO; TIE (Tie-1); TIMP3; tissue factor; TLR10; TLR2; TLR3;
TLR4; TLR5; TLR6; TLR7; TLR8; TLR9; TNF; TNF-a; TNFAIP2 (B94); TNFAIP3; TNFRSF11A;
TNFRSF1A; TNFRSF1B; TNFRSF21; TNFRSF5; TNFRSF6 (Fas); TNFRSF7; TNFRSF8; TNFRSF9;
TNFSF10 (TRAIL); TNFSF11 (TRANCE); TNFSF12 (APO3L); TNFSF13 (April); TNFSF13B;
TNFSF14 (HVEM-L); TNFSF15 (VEGI); TNFSF18; TNFSF4 (OX40 ligand); TNFSF5 (CD40 ligand);
TNFSF6 (FasL); TNFSF7 (CD27 ligand); TNFSF8 (CD30 ligand); TNFSF9 (4-1BB ligand); TOLLIP;
Toll-like receptors (TLR1, 2, 3, 4, 5, 6, 7, 8, 9, 10, 11, 12 to TLR-13); TOP2A (topoisomerase IIa); TP53;
TPM1; TPM2; TRADD; TRAF1; TRAF2; TRAF3; TRAF4; TRAF5; TRAF6; TREM1; TREM2; TRPC6;
TSLP; TWEAK; VAP1; VEGF; VEGFB; VEGFC; versican; VHL C5; VLA-1; VLA-4; XCL1
(lymphotactin); XCL2 (SCM-1b); XCR1 (GPR5/CCXCR1); YY1; ZFPM2.

3. Exemplary Biologically Active Proteins as Payloads

Proteinacious compounds that are specifically contemplated as payloads in the subject compositions are the following peptides and proteins:

"C-type Natriuretic peptide" or "CNP" means the human protein (UniProt No. P23582) encoded by the NPPC gene that is cleaved to the 22 amino acid peptide C-type natriuretic peptide (CNP), having the sequence GLSKGCF-GLKLDRIGSMSGLGC (SEQ ID NO: 539), as well as species and synthetic variations thereof, having at least a portion of the biological activity of the native peptide. CNP is a selective agonist for the B-type natriuretic receptor (NPRB) and is reported to be a potent stimulator of endochondral bone growth. CNP binds to its receptor, initiates intracellular signals & ultimately inhibit the overactive FGFR3 pathway. Use of CNP is indicated for achondroplasia, a common form of skeletal dysplasia or short-limbed dwarfism, and human disorders caused by FGFR3 mutations, including syndromes affecting skeletal development; e.g., hypochondroplasia [HCH], ACH, thanatophoric dysplasia [TD]), skin (epidermal nevi, seborrhaeic keratosis, acanthosis nigricans), and cancer (multiple myeloma [MM], prostate and bladder carcinoma, seminoma) (Foldynova-Trantirkova S. Hum Mutat (2012) 33:29). The half-life of CNP-22 is reported to be 2.6 min, being rapidly metabolized by neutral endopeptidase & cleared by a clearance receptor (Prickett T., 2004, Clinical Science, 106:535), thereby limiting its utility.

"Luteinizing hormone-releasing hormone" or "LHRH" means the human protein (UniProt No. P01148) encoded by the GNRH1 gene that is processed in the preoptic anterior hypothalamus from a 92-amino acid preprohormone into the linear decapeptide end-product having the sequence pyro-Glu-His-Trp-Ser-Tyr-Gly-Leu-Arg-Pro-Gly-NH2 (SEQ ID NO: 540), as well as species and synthetic variations thereof, having at least a portion of the biological activity of the native peptide. LHRH plays a pivotal role in the regulation of the pituitary/gonadal axis, and thus reproduction. LHRH exerts its effects through binding to high-affinity receptors on the pituitary gonadotroph cells and subsequent release of FSH and LH. LHRH is found in organs outside of the hypothalamus and pituitary, and because a high percentage of certain cancer tissues have LHRH binding sites and because sex steroids have been implicated in the development of breast and prostate cancers, hormonal therapy with LHRH agonists are approved or are considered for the treatment of sex-steroid-dependent conditions such as estrogen-dependent breast cancer, ovarian cancer, endometrial cancer, bladder cancer and androgen-dependent prostate carcinoma. Because the half-life is reported to be less than 4 minutes, (Redding T W, et al. The Half-life, Metabolism and Excretion of Tritiated Luteinizing Hormone-Releasing Hormone (LH-RH) in Man. J Clin Endocrinol. Metab. (1973) 37:626-631), its utility as a therapeutic is limited.

"Cilengitide" means the synthetic cyclic RGD pentapeptide having the sequence Arg-Gly-Asp-Dphe-NmeVal (SEQ ID NO: 541) or the chemical name 2-[(2S,5R,8S,11S)-5-benzyl-11-{3-[(diaminomethylidene)amino]propyl}-7-methyl-3,6,9,12,15-pentaoxo-8-(propan-2-yl)-1,4,7,10,13-pentaazacyclopentadecan-2-yl]acetic acid (CAS No. 188968-51-6). Cilengitide is selective for αv integrins, which are important in angiogenesis (forming new blood vessels). The binding of such ligands activates the integrins to regulate tumor cell invasion, migration, proliferation, survival & angiogenesis. Hence, the use of cilengitide is under investigation for the treatment of glioblastoma by inhibiting angiogenesis (Burke P, et al. Cilengitide targeting of αvβ3 integrin receptor synergizes with radioimmunotherapy to increase efficacy and apoptosis in breast cancer xenografts". Cancer Res (2002) 62(15): 4263-4272). Because cilengitide has a short half-life of 3-5 h. and poor solubility limiting the maximum drug concentration to 15 mg/mL (O'Donnell P H, A phase I study of continuous infusion cilengitide in patients with solid tumors. Invest New Drugs (2012) 30:604), its utility as a therapeutic is limited.

"Growth hormone releasing hormone" or "GHRH" (also known as growth-hormone-releasing factor, GRF, GHRF, somatoliberin or somatocrinin" means the 44-amino acid peptide hormone produced in the arcuate nucleus of the hypothalamus having the sequence YADAIFTNSYRKVL-GQLSARKLLQDIMSRQQGESNQERGARARL (SEQ ID NO: 542), as well as species and synthetic variations thereof, having at least a portion of the biological activity of the native peptide, including the biologically active 1-29 amino acid truncation peptide YADAIFTNSYRKVLGQL-SARKLLQDIMSR (SEQ ID NO: 543). GHRH is released from neurosecretory nerve terminals and is carried by the hypothalamo-hypophyseal portal system to the anterior pituitary gland where it acts on GHRH receptor to stimulate pulsatile growth hormone release. The GHRH analog tesamorelin is a drug approved for the treatment of lipodystrophy in HIV patients under highly active antiretroviral therapy, and is also considered for use in cachexia, abdominal obesity in growth-hormone deficient patients, muscle wasting related to certain chronic diseases, mild cognitive impairment, and growth hormone replacement in growth hormone deficient patients. Because the half-life is reported to be less than 15 minutes, (Chapman I M, J Endocrinol (1991) 128:369-374), its utility as a therapeutic is limited.

"Peptide YY" and "PYY" mean human peptide YY polypeptide (UniProt No. P10082), synthetic versions and species and non-natural sequence variants having at least a portion of the biological activity of mature PYY. As used herein, "PYY" includes both major forms of the human full length, 36 amino acid peptide, $PYY_{1-3}$ and the predominant circulating form $PYY_{3-36}$ ("PYY3-36") which have the PP fold structural motif. PYY3-36 has the sequence IKPEAPGEDASPEELNRYYASLRHYLNLVTRQRY-NH2 (SEQ ID NO: 544). PYY is produced by specialized endocrine cells (L-cells) in the gut after a person eats and inhibits gastric motility and increases water and electrolyte absorption in the colon. PYY may also suppress pancreatic secretion. The naturally occurring PYY3-36 is a nonselective $Y_1$, $Y_2$, & $Y_5$ agonist. PPY-containing fusion proteins of the invention may find particular use in the treatment of diabetes for glucose regulation, insulin-resistance disorders, and obesity. Analogs of PYY have been prepared, as described in U.S. Pat. Nos. 5,604,203, 5,574,010 and 7,166,575. Because the half-life is reported to be less than 1 h. (Addison M L. A role for metalloendopeptidases in the breakdown of the gut hormone, PYY 3-36. Endocrinology (2011) 152(12): 4630-4640) and is typically administered by the intranasal route three times daily, its utility as a therapeutic is limited.

"Leptin" means the naturally occurring leptin (UnitProt No. P41159) encoded by the Ob(Lep) gene, synthetic versions and species and non-natural sequence variants having at least a portion of the biological activity of the mature leptin. Leptin has the sequence VPIQKVQDDTKTLIK-TIVTRINDISHTQSVSSKQKVTGLDFIPGLHPILTLSK-MDQTLAVY QQILTSMPSRNVIQISNDLENLRDLLHV-LAFSKSCHLPWASGLETLDSLGGVLEASGYST EVVALSRLQGSLQDMLWQLDLSPGC (SEQ ID NO: 545), and has a disulfide bridge between residues 97 and 147. Leptin plays a key role in regulating energy intake and energy expenditure, including appetite, metabolism, and body weight. Leptin-containing polypeptides of the invention may find particular use in the treatment of diabetes for glucose regulation, insulin-resistance disorders, obesity, congenital/acquired lipodystrophy, HAART-induced lipodystrophy, hypothalamic amenorrhea. Leptin has been cloned, as described in U.S. Pat. No. 7,112,659, and leptin analogs and fragments in U.S. Pat. No. 5,521,283, U.S. Pat. No. 5,532,336, PCT/US96/22308 and PCT/US96/01471. Because the commercially available form, metreleptin has a half-life reported to be 8-30 min (Klein S., et al. Adipose tissue leptin production and plasma leptin kinetics in humans. Diabetes (1996) 45:984-987) and the majority of current leptin therapies require 1x-2x/day dosing, its utility as a therapeutic is limited.

"Pramlintide" means the synthetic amylin mimetic having the sequence KCNTATCATNRLANFLVHSSNNFGPIL-PPTNVGSNTY-NH2 (SEQ ID NO: 546), and sequence variants having at least a portion of the biological activity of pramlintide or native amylin. The pramlintide has a sequence wherein amino acids from the rat amylin sequence are substituted for amino acids in the human amylin sequence. Amylin is a 37aa peptide secreted by pancreatic b-cells that is co-released with insulin in pulsatile fashion, typically in a molar ratio of 100 insulin to 1 amylin. Amylin functions to inhibit gastric emptying, glucagon secretion, promote satiety & meal termination (Kong M F, et al. Infusion of pramlintide, a human amylin analogue, delays gastric emptying in men with IDDM. Diabetologia. (1997) 40:82-88). Pramlintide is used as an adjunct to insulin therapy in T1D and T2D and shows improvement in glycemic control and reduction in insulin requirements, and also demonstrate modest reduction in body weight (Neary M T, Batterham R L. Gut hormones: Implications for the treatment of obesity. Pharmacology & Therapeutics (2009)124: 44-56). Because pramlintide has a half-life reported to be 20 min (McQueen, J. Pramlintide acetate. Am. J. Health-System Pharmacy (2005) 22:2363-2372) and requires 2x-3x/day dosing, its utility as a therapeutic is limited.

"Oxytocin" means the mammalian hormone peptide (UniProt No. P01178) having the sequence CYIQNCPLG-NH2 (SEQ ID NO: 547) and a disulfide bridge between residues 1 and 6, and synthetic versions, such as pitocin. Oxytocin acts primarily as a neuromodulator in the brain, having a structure very similar to that of vasopressin, which are the only known hormones released by the human posterior pituitary gland to act at a distance. Oxytocin has uterine-contracting properties mediated by specific, high-affinity oxytocin receptors expressed in the mammary gland and the uterus: hence its role in parturition and lactation. Oxytocin-containing polypeptides of the invention may find particular use in the treatment of autism, fragile X syndrome, chronic daily headache, and male infertility.

"Relaxin" means the protein hormone that is a heterodimer of two peptide chains of 24 & 29 amino acids linked by disulfide bridges created from the 185 amino acid precursor protein (UniProt No. P04090); the B chain having the sequence DSWMEEVIKLCGRELVRAQIAICGMSTWS (SEQ ID NO: 548) and the A chain having the sequence QLYSALANKCCHVGCTKRSLARFC (SEQ ID NO: 549), with the disulfide bridges between B10-A10 and B23-A24, and includes synthetic and recombinant versions. Relaxin is produced by the corpus luteum during the menstrual cycle and pregnancy in women and by the prostate in men. Relaxin orchestrates many of the maternal physiological responses to pregnancy, acts as a systemic and renal vasodilator, is a cardioprotective & antifibrotic agent. Relaxin binds to relaxin receptor (GPCR), increases cAMP & activates PKC, PI3K & endothelin type B receptor resulting in increased nitric oxide production, and also activates MAPK, which may play a role in relaxin induced VEGF expression. Relaxin-containing polypeptides of the invention may find particular use in the treatment of acute decompensated heart failure (ADHF). Because the reported half-life of relaxin in humans is less than 10 min (Dschietzig T, et al. Intravenous recombinant human relaxin in compensated heart failure: a safety, tolerability, and pharmacodynamic trial. J Card Fail. 2009; 15:182-190), the utility of the unmodified protein as a therapeutic is limited.

"Cenderitide" and "CD-NP" means a human C-type natriuretic peptide-(32-53)-peptide (CNP-22) with eastern green mamba (Dendroaspis angusticeps) natriuretic peptide-(24-38)-peptide having the sequence GLSKGCFGLKLDRI-GSMSGLGCPSLRDPRPNAPSTSA (SEQ ID NO: 550), with disulfide bridges between residues 6 and 22. The chimeric peptide has vasoprotective and RAAS suppressing actions via activation of the receptors guanylyl cyclase (GC)-A and GC-B, and may potentiate renal enhancement and cardiac unloading while having minimal hypotensive effects. Accordingly, it may have use in treatment of cardiorenal disease such as acute decompensated heart failure (ADHF) and acute myocardial infarction (AMI), particularly during the "post-acute" treatment period.

"Peginesatide" or "hematide" is a peptide composed of two synthetic 21 amino-acid peptides having the sequence GlyGlyLeuTyrAlaCysHisMetGlyProIleThr1NalValCysGln-ProLeuArgSarLys (SEQ ID NO: 551) that are linked at lysine with a branched polyethylene glycol. Peginesatide is a novel analog of erythropoietin that has erythropoietic properties and is being developed for medical use as a treatment for anemia due to chronic kidney disease (CKD) in patients not on dialysis.

"Oxyntomodulin" or "OXM" means human oxyntomodulin, synthetic versions and sequence variants thereof having at least a portion of the biological activity of mature oxyntomodulin. Oxyntomodulin is a 37 amino acid peptide having the sequence HSQGTFTSDYSKYLDSRRAQD-FVQWLMNTKRNRNNIA (SEQ ID NO: 552), is produced postprandially from intestinal L-cells in the colon and contains the 29 amino acid sequence of glucagon followed by an 8 amino acid carboxyterminal extension. Oxyntomodulin is an agonist at both the glucagon receptor and the GLP-1R, with its anorectic effect probably mediated via the latter receptor. OXM has been found to suppress appetite. OXM-containing polypeptides of the invention may find particular use in the treatment of diabetes for glucose regulation, insulin-resistance disorders, obesity, and can be used as a weight loss treatment. As native oxyntomodulin has been reported to have a half-life of ~12 min in human plasma (measured with a cross-reacting glucagon assay; Schjoldager B T. Oxyntomodulin: a potential hormone from the distal gut. Pharmacokinetics and effects on gastric acid and insulin secretion in man. Eur J Clin Invest. (1988) 18(5): 499-503.), the utility of the unmodified protein as a therapeutic is limited.

"POT4" or "APL-1" means the synthetic cyclic peptide having the sequence H-Ile-[Cys-Val-Val-Gln-Asp-Trp-Gly-His-His-Arg-Cys]-Thr-NH2 (SEQ ID NO: 553). POT4 is a more potent C3 complement inhibitor than compstatin, which inhibits the cleavage of native C3 to its active fragments C3a and C3b, and has extended circulating in vivo half-life of 8 hours. It is considered for use to prevent inflammation, damage and upregulation of angiogenic factors like VEGF in diseases like age-related macular degeneration (AMD), paroxysmal nocturnal hemoglobinuria (PNH), asthma and COPD.

"Interferon-lambda", "IFN-λ", interleukin-29" and "IL-29" means the human interleukin (UniProt No. Q8IU54 (20-200)) encoded by the IL29 gene having the sequence GPVPTSKPTTTGKGCHIGRFKSLSPQELASFK-KARDALEESLKLKNWSCSSPVFPGNWDL RLLQVR-ERPVALEAELALTLKVLEAAAGPALEDVLDQPLHTL-HHILSQLQACIQPQPTAG PRPRGRLHHWLHRLQEAPKKESAGCLEASVTFNL-FRLLTRDLKYVADGNLCLRTSTHPE ST (SEQ ID NO: 554), recombinant and synthetic versions and sequence variants thereof having at least a portion of the biological activity of mature IL-29. A type III interferon, IL-29 signals through a heterodimer receptor complex (IL-10R2 & IL-28Rα receptor chains) distinct from type I IFN (IFNAR1/IFNAR2 receptor complex), and plays an Important role m anti-viral immunity. Notably, the IL-29 receptor is highly expressed on hepatocytes, the primary site of HCV infection, but is not significantly expressed on immune or bone marrow cells. Pegylated versions have an estimated half-life of 50-70 h.

"Interferon-beta" or "IFN-β" means the human protein encoded by the IFNB1 gene having the sequence MSYN-LLGFLQRSSNFQCQKLLWQLNGRLEYCLKDRMNFD-IPEEIKQLQQFQKEDAALTIYEMLQNIFAIFRQDSSST-GWNETIVENLLANVYHQINHLKTVLEEKLEKEDFTR-GKLMSSLHLKRYYGRILHYLKAKEYSHCAWTIVRV-EILRNFYFINRLTGYLRN (SEQ ID NO: 555), and recombinant and synthetic versions and sequence variants thereof having at least a portion of the biological activity of mature IFN-ß. IFN-ß is produced by various cell types including fibroblasts & macrophages, and mediates antiviral, antiproliferative & immunomodulatory activities in response to viral infection & other biological inducers. The binding of IFN-ß to specific receptors on the surface of human cells initiates a cascade of intracellular events that leads to the expression of numerous interferon-induced gene products such as 2', 5'-oligoadenylate synthetase, ß2-microglobulin, and neopterin. These gene products are routinely used as biomarkers in clinical setting. IFN-ß is used in treatment of various forms of multiple sclerosis (MS), including elapse remitting MS, secondary progressive MS, primary progressive MS, juvenile onset MS, and clinically isolated syndromes suggestive of MS. Commercially-available forms of IFN-ß have reported half-lives of 4 to 67 h and require frequent dosing, such that their utility as a therapeutic is limited.

"C-peptide" means the human pancreatic protein having the sequence EAEDLQVGQVELGGGPGAGSLQPLA-LEGSLQ (SEQ ID NO: 556), and recombinant and synthetic versions and sequence variants thereof having at least a portion of the biological activity of native C-peptide. C-peptide is the middle segment of proinsulin that is between the N-terminal B-chain and the C-terminal A-chain, and is cleaved from preproinsulin as mature insulin is formed and secreted. Circulating C-peptide binds to a receptor that is likely G-protein-coupled, and the signal activates Ca2+-dependent intracellular signaling pathways such as MAPK, PLCγ, and PKC, leading to upregulation of a range of transcription factors as well as eNOS and Na+K+ATPase activities. C-peptide is considered for use in diabetic complications and diabetic nephropathy. Since the reported half-life is about 30 minutes (Matthews D R. The half-life of endogenous insulin and C-peptide in man assessed by somatostatin suppression. Clin Endocrinol (Oxf). (1985) 23(1): 71-79), the utility of the unmodified protein as a therapeutic is limited.

"Ghrelin" means the human hormone having the sequence GSSFLSPEHQRVQQRKESKKPPAKLQPR (SEQ ID NO: 557), truncated versions, recombinant and synthetic versions and sequence variants thereof having at least a portion of the biological activity of native ghrelin, including the native, processed 27 or 28 amino acid sequence and homologous sequences. Ghrelin induces satiation, or species and non-natural sequence variants having at least a portion of the biological activity of mature ghrelin, including the native, processed 27 or 28 amino acid sequence and homologous sequences. Ghrelin is produced mainly by P/D1 cells lining the fundus of the human stomach and epsilon cells of the pancreas that stimulates hunger, and is considered the counterpart hormone to leptin. Ghrelin levels increase before meals and decrease after meals, and can result in increased food intake and increase fat mass by an action exerted at the level of the hypothalamus. Ghrelin also stimulates the release of growth hormone. Ghrelin is acylated at a serine residue by n-octanoic acid; this acylation is essential for binding to the GHS1a receptor and for the agonist activity and the GH-releasing capacity of ghrelin. Ghrelin-containing polypeptides of the invention may find particular use as agonists; e.g., to selectively stimulate motility of the GI tract in gastrointestinal motility disorder, to accelerate gastric emptying, or to stimulate the release of growth hormone. The invention also contemplates unacylated forms and sequence variants of ghrelin, which act as antagonists. Ghrelin analogs with sequence substitutions or truncated variants, such as described in U.S. Pat. No. 7,385,026, may find particular use as fusion partners to XTEN for use as antagonists for improved glucose homeostasis, treatment of insulin resistance and treatment of obesity, cancen cachexia, post-operative ileus, bowel disorders, and gastrointestinal disorders. The isolation and characterization of ghrelin has been reported (Kojima M, et al., Ghrelin is a growth-hormone-releasing acylated peptide from stomach. Nature. 1999; 402(6762):656-660) and synthetic analogs have been prepared by peptide synthesis, as described in U.S. Pat. No. 6,967,237. As ghrelin has a reported terminal half-life of 10-30 min (Akamizu T, et al. Pharmacokinetics, safety, and endocrine and appetite effects of ghrelin administration in young healthy subjects. Eur J. Endocrinology (2004)150(4): 447-455), the utility of the unmodified protein as a therapeutic is limited, and analogs with, at position 3, the native serine amino acid with an octyl side group instead of the native octanoyl side group may confer added resistant to proteases.

"Follistatin," also known as "activin-binding protein" or "FSH-suppressing protein (FSP)," means the protein that, in humans, is encoded by the FST gene. As used herein, "follistatin" includes homologs, species variants, sequence variants and fragments thereof. The mature protein form in humans has 315 amino acids, is referred to as FS-315 and has been cloned (U.S. Pat. Nos. 5,041,538 and 5,182,375). Follistatin contains two potential N-glycosylation sites, Asn95 and Asn259, however it has been demonstrated that mutation at these sites followed by testing of the recombinant product for their ability to inhibit FSH secretion and to bind activin resulted in each mutant having a similar property as the non-mutated recombinant hFS-315, suggesting that glycosylation of the follistatin molecule has no effect in these functions (Inouye, S., et al. Site-specific mutagenesis of human follistatin. BBRC (1991) 179(1):352-358). Porcine follistatin is disclosed in Ueno et al., PNAS:USA 84:8282-8286 (1987) and bovine follistatin is disclosed in Robertson et al., Biochem. Biophys. Res. Commun. 149: 744-749 (1987). As bone morphogenetic proteins and growth/differentiation factors such as activin and myostatin have the ability to induce the growth, formation, differentiation and maintenance of various tissues, including bone, cartilage, tendon/ligament, muscle, neural, and various organs, their neutralization by follistatin and follistatin agonists have therapeutic value (U.S. Pat. Nos. 5,545,616, 5,041,538, and AU9675056). As follistatin administered to a subject is rapidly eliminated from the circulation, with a terminal half-life of just over 2 hours in rats (Kogure K, et al. Intravenous administration of follistatin: delivery to the liver and effect on liver regeneration after partial hepatectomy. Hepatology. (1996) 24(2):361-366), the utility of the unmodified protein as a therapeutic is limited.

"Vasoactive intestinal peptide" and "VIP" means the 28 amino acid peptide hormone (UniProt No. P01282 (125-152)) encoded by the VIP gene residues having the sequence HSDAVFTDNYTRLRKQMAVKKYLNSILN-NH2 (SEQ ID NO: 558) and recombinant and synthetic versions and sequence variants thereof having at least a portion of the biological activity of native VIP. The VIP peptide is produced in many tissues, including the gut, pancreas and suprachiasmatic nuclei of the hypothalamus in the brain. VIP stimulates contractility in the heart, causes vasodilation, increases glycogenolysis, lowers arterial blood pressure and relaxes the smooth muscle of trachea, stomach and gall bladder. Changes in concentration are associated with myocardial fibrosis, heart failure, cardiomyopathy and pulmonary hypertension, and its deficiency in the respiratory system is considered to be a pathogenetic factor in pulmonary disease (Said S I, 2007, Circulation, 115: 1260; Said S I, 2008, Ann N Y Acad Sci, 1144:148; Petkov V et. al., 2003, J Clin Invest, 111:1339). VIP is considered for use in treating resistant hypertension, primary pulmonary arterial hypertension (PAH), asthma. COPD, diabetes, erectile dysfunction, and female sexual dysfunction. As its half-life is reported to be approximately 1 minute (Domschke S, et al. Vasoactive intestinal peptide in man: pharmacokinetics, metabolic and circulatory effects. Gut (1978) 19:1049-1053), the utility of the unmodified protein as a therapeutic is limited.

"Fuzeon" means the 36 amino acid peptide derived from the gp41 of HIV, a viral protein involved in fusion of HIV to CD4+ T cells, having the sequence YTSLIHSLIEESQN-QQEKNEQELLELDKWASLWNWF (SEQ ID NO: 559), and recombinant and synthetic versions and sequence variants thereof having at least a portion of the binding activity of native gp41. Fuzeon and multimers thereof or conjugates with related peptides are used or are being considered for use in treating resistant forms of HIV infection. As fuzeon has a half-life of 3.8 h in patients, requiring frequent injection administrations, its utility is limited.

"KAI-4169" means the peptide agonist of the human cell surface calcium-sensing receptor (CaSR) under development by KAI Pharma for the treatment of secondary hyperparathyroidism (SHPT) in kidney disease patients and bone disorder (CKD-MBD) patients.

"Pasireotide" means the a somatostatin analog having the chemical name [(3S,6S,9S,12R,15S,18S,20R)-9-(4-aminobutyl)-3-benzyl-12-(1H-indol-3-ylmethyl)-2,5,8,11,14,17-hexaoxo-15-phenyl-6-[(4-phenylmethoxyphenyl)methyl]-1,4,7,10,13,16-hexazabicyclo[16.3.0]henicosan-20-yl] N-(2-aminoethyl)carbamate used for the treatment of Cushing's disease. Pasireotide is a multi-receptor somatostatin analogue with high binding affinity for somatostatin-R-subtypes R1, 2, 3 & 5 that suppresses growth hormone, IGF-1 and adrenocorticotropic hormone secretion. In addition to treatment of Cushing's Disease, it is also considered for use in acromegaly, neuroendocrine disease, liver disease, symptomatic polycystic liver disease, neuroendocrine tumor, lympangioleiomyomatosis, congenital hyperinsulinism, recurrent or progressive meningioma, and other endocrine disorders. As a commercially-available form has a reported half-life of 12 to 17 h (Petersenn, S. et al. Tolerability and Dose Proportional Pharmacokinetics of Pasireotide Administered as a Single Dose or Two Divided Doses in Healthy Male Volunteers: A Single-Center, Open-Label. Ascending-Dose Study. Clinical Therapeutics (2012) 34:677-688), its utility is limited.

"Irisin" means the clevage product of the protein encoded by the FNDC5 gene having the sequence DSPSAPVNVT-VRHLKANSAVVSWDVLEDEVVIGFAISQQKKDVRM-LRFIQEVNTTTRSC ALWDLEEDTEYIVHVQAI-SIQGQSPASEPVLFKTPREAEKMASKNKDEVTMKE (SEQ ID NO: 560), and recombinant and synthetic versions and sequence variants thereof having at least a portion of the biological activity of native irisin. Irisin mediates beneficial effects of muscular exercise, and induces browning of white adipose tissue by up-regulating UCP1 expression through activation of the nuclear receptor PPARA. Mildly increased irisin levels have been shown to result in increased energy expenditure, reduced body weight and improved diet-induced insulin resistance (Bostrom P, 2012, Nature, 481:463). Irisin is considered for use in treating obesity, diabetes, and metabolic disorders.

"TXA127" and "PanCyte" are analogs of angiotensin (1-7), with TXA127 having the sequence NRVYIHP (SEQ ID NO: 561) and PanCyte is an cyclic analog linking the 4th and 7th residues with dAla and Ala, respectively, with the result that it is more resistant to degradation and has a longer half-life. The analogs bind to MAS receptor and stimulate early hematopoietic precursor cells in bone marrow, and also have vasodilation, anti-trophic, antifibrotic, natriuresis, anti-inflammatory, anti-thrombotic effects. The compounds are considered for use in acceleration of platelet recovery following stem cell transplant for patients with hematological cancers such as acute myelogenous leukemia (AML), myelodysplastic syndrome (MDS), acute lymphocytic leukemia (ALL), chronic myelogenous leukemia (CML), chronic lymphocytic leukemia (CLL), Hodgkin's lymphoma (HL), or non-Hodgkin's lymphoma (NHL), and multiple myeloma, and use in treating pulmonary fibrosis, acute lung injury, pulmonary arterial hypertension, and fibrosis of the kidney and liver.

"Interleukin-7" and "IL-7" means the human interleukin (UniProt No. P13232 (26-177)) encoded by the IL7 gene having the sequence DCDIEGKDGKQYESVLM-VSIDQLLDSMKEIGSNCLNNEFNFFKRHICDANKEG-MFLFRA ARKLRQFLKMNSTGDFDLHLLKVSEGT-TILLNCTGQVKGRKPAALGEAQPTKSLEENKS LKEQKKLNDLCFLKRLLQEIKTCWNKILMGTKEH (SEQ ID NO: 562), and recombinant and synthetic versions and sequence variants thereof having at least a portion of the biological activity of native IL-7. IL-7 IL-7 stimulates the differentiation of multipotent (pluripotent) hematopoietic stem cells into lymphoid progenitor cells, including expansion of CD4/CD8 T cells. IL-7 limits the production of suppressor regulatory T cells and T cell anergy through TGF-B antagonism, and supports production of central memory T cells. IL-7 is considered for use in treating lymphopenia in HIV, oncology, transplant, HBV and HCV infection, as well as treating minimal residual disease or advanced tumors, and may have roles in immune reconstitution or enhancement of immunotherapy. As the reported half-life of IL-7 in humans is approximately 10 h (Sportès, C. et al. Phase I Study of Recombinant Human Interleukin-7 Administration in Subjects with Refractor) Malignancy, Clin Cancer Res 2010; 16:727-735), its utility in unmodified form is limited.

"Fibroblast growth factor 18" or "FGF-18" means the human protein (UniProt No. O76093(28-207)) encoded by the FGF18 gene, having the sequence EENVDFRTIHVEN-QTRARDDVSRKQLRLYQLYSRTSGKHIQVLGRRI-SARGEDGDKYAQL LVETDTFGSQVRIKGKETEFYLC-MNRKGKLVGKPDGTSKECVFIEKVLENNYTALMSAK YSGWYVGFTKKGRPRKGPKTRENQQDVHFMKRYP-KCPELQKPFKYTTVTKRSRRIRP THPA (SEQ ID NO: 563) and recombinant and synthetic versions and sequence variants thereof having at least a portion of the biological activity of native FGF-18. FGF-18 is a protein member of the fibroblast growth factor (FGF) family. FGF family members possess broad mitogenic and cell survival activities, and are involved in a variety of biological processes, including embryonic development, cell growth, morphogenesis, tissue repair, tumor growth, and invasion. It has been shown in vitro that this protein is able to induce neurite outgrowth in PC12 cells. FGF-18 stimulates the proliferation of chondrocyte & osteoblasts (cells that produce and maintain bone and cartilage) and its use is considered for the repair and generation of the cartilage, for example in the knee joints (Ellsworth J L. Fibroblast growth factor-18 is a trophic factor for mature chondrocytes and their progenitors. Osteoarthritis Cartilage (2002) 10:308-320).

"Alpha-Melanocyte Stimulating Hormone" or "α-MSH" is the 13-amino acid peptide generated as a proteolyic cleavage product from ACTH (1-13), which is in turn a cleavage product of proopiomelanocortin (POMC), having the sequence N-Ac-SYSMGFRWGLPV (SEQ ID NO: 564), and synthetic versions and sequence variants thereof having at least a portion of the biological activity of native α-MSH. Alpha-MSH is a non-selective agonist of the melanocortin receptors MC1, MC3, MC4 & MC5 but not MC2 (which is exclusive for ACTH). Alpha-MSH stimulates melanocytes to produce & release melanin which has a photo-protective effect; it signals the brain, which has effects on appetite and sexual arousal. It is considered for use in treating erythropoietic protoporphyria (EPP, intolerant to sun), nonsegmental vitilligo (skin discoloration), actinic keratosis (AK, solar keratosis, precursor to skin cancer), polymorphous light eruption (PLE/PMLE), post-surgery kidney damage, erectile dysfunction, and sexual dysfunction. Because its half-life is mere seconds, its utility in unmodified form is limited.

"Endostatin" means the naturally-occurring 20-kDa C-terminal fragment derived from type XVIII collagen (UniProt. No. P39060(1572-1754)) having the sequence HSHRDFQPVLHLVALNSPLSGGMRGIRGAD-FQCFQQARAVGLAGTFRAFLSSRLQDLYS IVR-RADRAAVPIVNLKDELLFPSWEALFSGSEGPLKP-GARIFSFDGKDVLRHPTWPQKSV WHGSDPNGRRLTESYCETWRTEAPSATGQASSLLG-GRLLGQSAASCHHAYIVLCIENSF MTASK (SEQ ID NO: 565), and recombinant and synthetic versions and sequence variants thereof having at least a portion of the biological activity of native endostatin. Endostatin is an angiogenesis inhibitor and may interfere with the pro-angiogenic action of growth factors such as basic fibroblast growth factor (bFGF/FGF-2) and VEGF. It is considered for use in certain cancers. Because its half-life is 13 h (Thomas, J P et al. Phase I Pharmacokinetic and Pharmacodynamic Study of Recombinant Human Endostatin in Patients With Advanced Solid Tumors. J. Clin. Oncol. (2003) 21:223-231), its utility in unmodified form is limited.

"Humanin" means the peptide (UniProt No. Q8IVG9(1-24)) encoded by the MT-RNR2 gene, having the sequence MAPRGFSCLLLLTSEIDLPVKRRA (SEQ ID NO: 566), and recombinant and synthetic versions and sequence variants thereof having at least a portion of the biological activity of native humanin. Humanin has a role in neuroprotection against cell death associated with Alzheimer's disease (AD). AD-specific insults, prion induced apoptosis & chemically induced neuronal damage (Hashimoto, Y, A rescue factor abolishing neuronal cell death by a wide spectrum of familial Alzheimer's disease genes and Aβ. PNAS (2001) 986336-6341). More recently, humanin was found to help improve insulin action and lower blood glucose levels (Muzumdar R H, Humanin: A Novel Central Regulator of Peripheral Insulin Action PLoS One (2009) 4:e6334). Humanin s considered for use in treating Alzheimer's disease, diabetes, and vascular & cardiovascular diseases.

"Glucagon" means the human glucagon glucose regulating peptide having the sequence HSQGTFTSDYSKYLD-SRRAQDFVQWLMNT (SEQ ID NO: 567), and recombinant and synthetic versions and sequence variants thereof having at least a portion of the biological activity of native glucagon. The term "glucagon" as used herein also includes peptide mimetics of glucagon. Native glucagon is produced by the pancreas, released when blood glucose levels start to fall too low, causing the liver to convert stored glycogen into glucose and release it into the bloodstream. While the action of glucagon is opposite that of insulin, which signals the body's cells to take in glucose from the blood, glucagon also stimulates the release of insulin, so that newly-available glucose in the bloodstream can be taken up and used by insulin-dependent tissues. Glucagon-containing polypeptides of the invention may find particular use in increasing blood glucose levels in individuals with extant hepatic glycogen stores and maintaining glucose homeostasis in diabetes. Glucagon has been cloned, as disclosed in U.S. Pat. No. 4,826,763.

"Glucagon-like protein-1" or "GLP-1" means human glucagon like peptide-1 and sequence variants thereof having at least a portion of the biological activity of native GLP-1. The term "GLP-1" includes human GLP-1(1-37) having the sequence HDEFERHAEGTFTSDVSSTLEGQAALEFIAWLVKGRG (SEQ ID NO: 568), GLP-1(7-37), and GLP-1(7-36)amide. GLP-1 stimulates insulin secretion, but only during periods of hyperglycemia. The safety of GLP-1 compared to insulin is enhanced by this property and by the observation that the amount of insulin secreted is proportional to the magnitude of the hyperglycemia. The biological half-life of GLP-(7-37)OH is a mere 3 to 5 minutes (U.S. Pat. No. 5,118,666). GLP-1-containing polypeptides of the invention may find particular use in the treatment of diabetes and insulin-resistance disorders for glucose regulation. GLP-1 has been cloned and derivatives prepared, as described in U.S. Pat. No. 5,118,666.

"Glucagon-like protein-2" or "GLP-2" means, collectively herein, human glucagon like peptide-2 having the sequence HADGSFSDEMNTILDNLAARDFINWLIQTKITD (SEQ ID NO: 569), species homologs of human GLP-2, and non-natural sequence variants having at least a portion of the biological activity of mature GLP-2 including variants such as, but not limited to, a variant with glycine substituted for alanine at position 2 of the mature sequence resulting in HGDGSFSDEMNTILDNLAARDFINWLIQTKITD (SEQ ID NO: 570) ("2G") as well as Val, Glu, Lys, Arg, Leu or Ile substituted for alanine at position 2. GLP-2 or sequence variants have been isolated, synthesized, characterized, or cloned, as described in U.S. Pat. Nos. 5,789,379; 5,834,428; 5,990,077; 5,994,500; 6,184,201; 7,186,683; 7,563,770; 20020025933; and 20030162703.

"Insulin" means human insulin or a homolog, species variants, or sequence variants thereof that includes, but is not limited to, the mature human insulin protein composed of 51 amino acids with a molecular weight of 5808 Da and the proinsulin precursor of 110 amino acids. The precursor protein is processed to mature insulin that has an A-chain with sequence GIVEQCCTSICSLYQLENYCN (SEQ ID NO: 571) and a B-chain with sequence FVNQHLCGSHLVEALYLVCGERGFFYTPKT (SEQ ID NO: 572) bound together by disulfide bonds.

"Factor XIII A chain", "FXIIIA" or "F13A" means the coagulation protein (UniProt No. P00488(2-732)) having the sequence SETSRTAFGGRRAVPPNNSNAAEDDLPTVELQGVVPRGVNLQEFLNVTSVHLFKERWDTNKVDHHTDKYENNKLIVRRGQSFYVQIDFSRPYDPRRDLFRVEYVIGRYPQENKGTYIPVPIVSELQSGKWGAKIVMREDRSVRLSIQSSPKCIVGKFRMYVAVWTPYGVLRTSRNPE TDTYILFNPWCEDDAVYLDNEKEREEYVLNDIGVI FYGEVNDIKTRSWSYGQFEDGILDT CLYVMDRAQMDLSGRGNPIKVSRVGSAMVNAKDDEGVLVGSWDNIYAYGVPPSAWT GSVDILLEYRSSENPVRYGQCWVFAGVFNTFLRCLGIPARIVTNYFSAHDNDANLQMDIF LEEDGNVNSKLTKDSVWNYHCWNEAWMTRPDLPVGFGGWQAVDSTPQENSDGMYRC GPASVQAIKHGHVCFQFDAPFVFAEVNSDLIYITAKKDGTHVVENVDATHIGKLIVTKQI GGDGMMDITDTYKFQEGQEEERLALETALMYGAKKPLNTEGVMKSRSNVDMDFEVEN AVLGKDFKLSITFRNNSHNRYTITAYLSANITFYTGVPKAEFKKETFDVTLEPLSFKKEAV LIQAGEYMGQLLEQASLHFFVTARINETRDVLAKQKSTVLTIPEIIIKVRGTQVVGSDMT VTVQFTNPLKETLRNVWVHLDGPGVTRPMKKMFREIRPNSTVQWEEVCRPWVSGHRK LIASMSSDSLRHVYGELDVQIQRRPSM (SEQ ID NO: 573), and recombinant and synthetic versions and sequence variants thereof having at least a portion of the biological activity of native FXIIIA. Factor XIII is the last enzyme in the coagulation cascade and is responsible for cross-linking fibrin molecules to each other in a newly formed blood clot. By forming intermolecular covalent bonds between fibrin monomers and by cross-linking alpha-2 antiplasmin, fibrinogen, fibronectin, collagen, and other proteins to enhance the mechanical strength of the fibrin clot, protect from proteolytic degradation, and provide stability to the extracellular matrix. Plasma FXIII circulates as a heterotetramer composed of 2 A subunits and 2 B subunits noncovalently linked together and bound to fibrinogen. The B subunit, which appears to stabilize the structure of the A subunit and to protect the A subunit from proteolysis, is normally present in excess in plasma as free FXIII-B subunit. Most patients with FXIII deficiency have mutations in the FXIII-A subunit; few cases of patients with FXIII-B subunit mutations have been reported (Mikkola, H, 1996, Semin Thromb Hemost, 22:393; Ichinose A, 1996, Semin Thromb Hemost, 22:385). FXIIIA is used or is considered for use in treating hemophilia and related coagulopathies, congenital FXIII deficiency, and acquired FXIII deficiency due to chronic liver disease, inflammatory bowel disease, and post-surgery bleeding.

"Factor X" or "FX" means the coagulation protein (UniProt No. P00742(2-488)) having the sequence GRPLHLVLLSASLAGLLLLGESLFIRREQANNILARVTRANSFLEEMKKGHLERECMEET CSYEEAREVFEDSDKTNEFWNKYKDGDQCETSPCQNQGKCKDGLGEYTCTCLEGFEGK NCELFTRKLCSLDNGDCDQFCHEEQNSVVCSCARGYTLADNGKACIPTGPYPCGKQTLE RRKRSVAQATSSSGEAPDSITWKPYDAADLDPTENPFDLLDFNQTQPERGDNNLTRIVG GQECKDGECPWQALLINEENEGFCGGTILSEFYILTAAHCLYQAKRFKVRVGDRNTEQE EGGEAVHEVEVVIKHNRFTKETYDFDIAVLRLKTPITFRMNVAPACLPERDWAESTLMT QKTGIVSGFGRTHEKGRQSTRLKMLEVPYVDRNSCKLSSSFIITQNMFCAGYDTKQEDA CQGDSGGPHVTRFKDTYFVTGIVSWGEGCARKGKYGIYTKVTAFLKWIDRSMKTRGLP KAKSHAPEVITSSPLK (SEQ ID NO: 574), and recombinant and synthetic versions and sequence variants thereof having at least a portion of the biological activity of native FX. Factor X is activated into factor Xa by both factor IX (with its cofactor, factor VIII, to make a complex known as intrinsic Xase) and factor VII with its cofactor, tissue factor (to make a complex known as extrinsic Xase). Factor X is the first member of the final cognomen (or thrombin) pathway Factor X is used to treat factor X deficiency, hemophilia A & B using bypass strategies due to FVIII and FIX patients developing inhibitory antibodies to FVIII and FIX replacement therapies), emergency treatment of patients with hemorrhages due to oral anticoagulants overdose or unknown causes of critical bleeding, and patients who develop acquired FX deficiency caused by lack of vitamin K, amyloidosis, severe liver disease & use of anticoagulants (e.g. warfarin). While the half-life of mature factor X is 40-45 h. the plasma half-life of activated factor X (Fxa) is <1-2 min ((Bunce M W, 2008, Blood, 117:290), making its utility in unmodified form limited being rapidly inactivated by anti-thrombin III & TFP1.

4. Nucleic Acids as Payloads

The invention also contemplates the use of nucleic acids as payloads in the XTEN conjugates. In one embodiment, the invention provides XTEN-payload conjugates wherein the payload is selected from the group consisting of aptamers, antisense oligonucleotides, ribozyme nucleic acids, RNA interference nucleic acids, and antigene nucleic acids. Such nucleic acids used as therapeutics are know in the art (Edwin Jarald, Nucleic acid drugs: a novel approach. African Journal of Biotechnology Vol. 3 (12):662-666, 2004; Joanna B. Opalinska. Nucleic-acid therapeutics: basic principles and recent applications. Nature Reviews Drug Discovery 1:503-514, 2002).

IV). XTEN-Cross-Linker and XTEN-Payload Conjugates and Methods of Making Such Conjugates The present invention relates in part to highly purified preparations of XTEN-cross-linker conjugate compositions useful as conjugation partners to which payloads are conjugated, as described herein. The invention also relates to highly purified preparations of payloads linked to one or more XTEN using the XTEN-cross-linker conjugation partners. The present invention encompasses compositions and methods of making the XTEN-payload conjugates formed by linking of any of the herein described XTEN with a payload, as well as reactive compositions and methods of making the compositions formed by conjugating XTEN with a cross-linker or other chemical methods described herein. It is specifically intended that the terms "XTEN-payload" and "XTEN-cross-linker" encompass the linked reaction products remaining after the conjugation of the reactant conjugation partners, including the reaction products of cross-linkers, click-chemistry reactants, or other methods described herein.

In some embodiments, the XTEN utilized to create the subject conjugates comprise XTEN selected from any one of the sequences in Table 2, Table 3, and Tables 22-25, which may be linked to the payload component directly or via cross-linkers disclosed herein. In other embodiments, the one or more XTEN utilized to create the subject conjugates individually comprise an XTEN sequence having at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to an XTEN selected from Tables 2, 3, and 22-25 or a fragment thereof, when optimally aligned with a sequence of comparable length. In one embodiment, the subject conjugates are multimeric in that they comprise a first and a second XTEN sequence, wherein the XTEN are the same or they are different and wherein each individually comprises an XTEN sequence having at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to an XTEN selected from Tables 2, 3, and 22-25 or a fragment thereof, when optimally aligned with a sequence of comparable length. In another embodiment, the subject conjugates are multimeric in that they comprise a first, a second, and a third XTEN sequence, wherein the XTEN are the same or they are different and wherein each individually comprises an XTEN sequence having at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to an XTEN selected from Tables 2, 3, 22-25 or a fragment thereof, when optimally aligned with a sequence of comparable length. In yet another embodiment, the subject conjugates are multimeric in that they comprise 3, 4, 5, 6 or more XTEN sequences, wherein the XTEN are the same or they are different and wherein each individually comprises an XTEN sequence having at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to an XTEN selected from Tables 2, 3, and 22-25 or a fragment thereof. In the multimeric conjugates, the cumulative length of the residues in the XTEN sequences is greater than about 200 to about 3000 or about 400 to about 1000 amino acid residues, and the XTEN can be identical or they can be different in sequence or in length. As used herein, cumulative length is intended to encompass the total length, in amino acid residues, when more than one XTEN is incorporated into the conjugate.

In one aspect, the invention provides compositions of XTEN covalently linked to a small molecule payload drug, resulting in an XTEN-drug conjugate ("XTEN-D"). In another aspect, the invention provides compositions of XTEN covalently linked to a payload biologically active protein (which encompasses peptides or polypeptides), resulting in an XTEN-peptide/polypeptide conjugate ("XTEN-P"). In another aspect, the invention provides compositions of one or more XTEN recombinantly linked to a payload peptide or polypeptide, resulting in an XTEN-peptide/polypeptide recombinant fusion protein ("XTEN-PR"). In another aspect, the invention provides compositions of one or more XTEN linked to payloads of one or more drugs and one or more proteins that can be biologically active or can be targeting moieties. In particular, the invention provides isolated XTEN-D, XTEN-P, XTEN-PR, and XTEN-D-P compositions useful in the treatment of a condition for which the administration of a payload drug and/or protein is known in the art to be useful in the treatment, amelioration or prevention of a disease or condition in a subject. The XTEN-D conjugates generally comprise one or more of the following components: 1) XTEN; 2) cross-linker, and 3) payload to which the XTEN is chemically conjugated either directly or by use of a cross-linker, such as commercially-available cross-linkers described herein, or by use of click-chemistry reactants, or in some cases, may be created by conjugation between reactive groups in the XTEN and payload without the use of a linker as described herein. The XTEN-P generally comprise one or more of the following components: 1) XTEN; 2) cross-linker; and 3) biologically active protein payload, and are also generally created by conjugation with the use of a cross-linker or click-chemistry reactants. The XTEN-PR conjugates generally comprises one or more of the following components: 1) one or more XTEN; 2) a spacer sequence and 3) payload. The XTEN-D-P generally comprise one or more of the following components: 1) XTEN; 2) optional linker; 3)

biologically active protein; and 4) drug, wherein the payloads are generally created by conjugation with the use of a cross-linker or click-chemistry reactants, as described above. However, in some cases of foregoing types of compositions, the composition can be created without the use of a cross-linker provided the components are otherwise chemically reactive.

The conjugation of XTEN to payloads confers several advantages on the resulting compositions compared to the payloads not linked to XTEN. As described more fully below, non-limiting examples of the enhanced properties include increases in the overall solubility and metabolic stability, reduced susceptibility to proteolysis in circulation, reduced immunogenicity, reduced rate of absorption when administered subcutaneously or intramuscularly, reduced clearance by the kidney, enhanced interactions with substrate, reduced toxicity, targeted delivery of payload, and enhanced pharmacokinetic properties. Enhanced pharmacokinetic properties of the conjugates compared to payload not linked to XTEN include longer terminal half-life (e.g., two-fold, three-fold, four-fold or more), increased area under the curve (AUC) (e.g., 25%, 50%, 100% or more), lower volume of distribution, slower absorption after subcutaneous or intramuscular injection (an advantage compared to commercially-available forms of payload that must be administered by a similar route) such that the Cmax is lower, which, in turn, results in reductions in adverse effects of the payload that, collectively, results in an increased period of time that a conjugation composition administered to a subject provides therapeutic activity. In some embodiments, the conjugation compositions comprise cleavage sequences (described more fully, below) that permits sustained release of active payload, such that the administered XTEN-payload acts as a depot when subcutaneously or intramuscularly administered. It is specifically contemplated that XTEN-payload conjugates can exhibit one or more or any combination of the improved properties disclosed herein. As a result of these enhanced properties, the XTEN-payload conjugates permit less frequent dosing, more tailored dosing, and/or reduced toxicity compared to payload not linked to XTEN and administered in a comparable fashion. Such XTEN-payload conjugates have utility to treat certain conditions known in the art to be affected, ameliorated, or prevented by administration of the payload to a subject in need thereof, as described herein.

1. Cross-linker and azide/alkyne click-chemistry reactants for conjugation

In another aspect, the invention relates to XTEN conjugated to cross-linkers, resulting in XTEN-cross-linker conjugates that can be utilized to prepare XTEN-payload conjugation compositions. In particular, the herein-described XTEN-cross-linker conjugate partners are useful for conjugation to payload agents or surfaces bearing at least one thiol, amino, carboxyl, aldehyde or alcohol or any other reactive group available and suitable, as known in the art, for reaction between the components described herein.

In another aspect, the invention relates to methods of making conjugates of XTEN-cross-linker reactants and XTEN-click-chemistry azide/alkyne reactants, resulting in conjugates that can be utilized to prepare the subject XTEN-payload compositions. In particular, the herein-described methods for making XTEN-cross-linkers and XTEN-azide/alkyne reactants are useful wherein the payload agent or a reaction surface bears at least one thiol, amino, carboxyl, aldehyde, alkene, alkyne, heterocycle, alcohol, or other reactive group available for reaction.

Exemplary embodiments of XTEN have been described above, including preparations of substantially homogeneous XTEN. The invention provides XTEN that further serve as a platform to which payloads can be conjugated, such that they serve as a "carrier", conferring certain desirable pharmacokinetic, chemical and pharmaceutical properties to the compositions, amongst other properties described below. In other embodiments, the invention provides polynucleotides that encode XTEN that can be linked to genes encoding peptide or polypeptide payloads that can be incorporated into expression vectors and incorporated into suitable hosts for the expression and recovery of the subject XTEN-payload recombinant fusion proteins.

In some embodiments, the XTEN components as described herein, above, are engineered to incorporate a defined number of reactive amino acid residues that can be reacted with cross-linking agents or can further contain reactive groups that can be used to conjugate to payloads. In one embodiment, the invention provides cysteine-engineered XTEN wherein the cysteine, each of which contains a reactive thiol group, are conjugated to a cross-linker, resulting in an XTEN-cross-linker conjugate. In another embodiment, invention provides lysine-engineered XTEN wherein lysine, each of which contains a positively charged hydrophilic ε-amino group, are conjugated to a cross-linker, resulting in an XTEN-cross-linker conjugate. In the embodiments of cysteine-engineered XTEN, each comprises about 1 to about 100 cysteine amino acids, or from 1 to about 50 cysteine amino acids, or from 1 to about 40 cysteine amino acids, or from 1 to about 20 cysteine amino acids, or from 1 to about 10 cysteine amino acids, or from 1 to about 5 cysteine amino acids, or 9 cysteines, or 3 cysteines, or a single cysteine amino acid that is available for conjugation. In the embodiments of lysine-engineered XTEN, each comprises about 1 to about 100 lysine amino acids, or from 1 to about 50 lysine amino acids, or from 1 to about 40 lysine engineered amino acids, or from 1 to about 20 lysine engineered amino acids, or from 1 to about 10 lysine engineered amino acids, or from 1 to about 5 lysine engineered amino acids, or 9 cysteines, or 3 cysteines, or a single lysine that is available for conjugation. In another embodiment, the engineered XTEN comprises both cysteine and lysine residues of the foregoing ranges or numbers.

Generally, XTEN cysteine thiol groups are more reactive, i.e., more nucleophilic, towards electrophilic conjugation reagents than amine or hydroxyl groups. In addition, cysteine residues are generally found in smaller numbers in a given protein; thus are less likely to result in multiple conjugations within the same protein. Cysteine residues have been introduced into proteins by genetic engineering techniques to form covalent attachments to ligands or to form new intramolecular disulfide bonds (Better et al (1994) J. Biol. Chem. 13:9644-9650; Bernhard et al (1994) Bioconjugate Chem. 5:126-132; Greenwood et al (1994) Therapeutic Immunology 1:247-255; Tu et al (1999) Proc. Natl. Acad. Sci USA 96:4862-4867; Kanno et al (2000) J. of Biotechnology, 76:207-214; Chmura et al (2001) Proc. Nat. Acad. Sci. USA 98(15):8480-8484; U.S. Pat. No. 6,248, 564).

Figure 2:
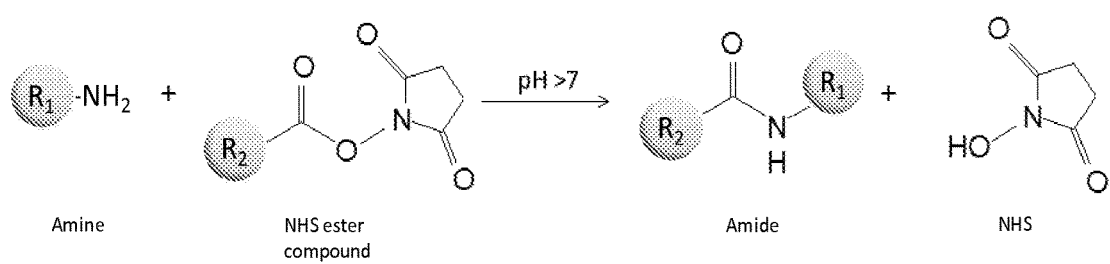
FIG. 2 shows a conjugation reaction utilizing NHS-esters and their water soluble analogs sulfo-NHS-esters) reacting with a primary amino group to yield a stable amide XTEN-payload product.

In one embodiment, the invention provides an isolated composition comprising a cysteine-engineered XTEN conjugated to a cross-linker, wherein the cross-linker is selected from sulfhydryl-reactive homobifunctional or heterobifunctional cross-linkers. In another embodiment, the invention provides an isolated composition comprising a lysine-engineered XTEN conjugated by a cross-linker, wherein the cross-linker is selected from amine-reactive homobifunctional or heterobifunctional cross-linkers. Cross-linking is the process of chemically linking two or more molecules by a covalent bond. The process is also called conjugation or bioconjugation with reference to its use with proteins and other biomolecules. For example, proteins can be modified to alter N- and C-termini, and amino acid side chains on proteins and peptides in order to block or expose reactive binding sites, inactivate functions, or change functional groups to create new targets for cross-linking In one aspect, the invention provides methods for the site-specific conjugation to XTEN polymer, accomplished using chemically-active amino acid residues or their derivatives (e.g., the N-terminal α-amine group, the ε-amine group of lysine, the thiol group of cysteine, the C-terminal carboxyl group, carboxyl groups of glutamic acid and aspartic acid. Functional groups suitable for reactions with primary α- and ε-amino groups are chlorocyanurates, dichlorotreazines, trezylates, benzotriazole carbonates, p-nitrophenyl carbonates, trichlorophenyl carbonates, aldehydes, mixed anhydrides, carbonylimidazoles, imidoesters, N-hydroxysuccinimide esters, N-hydroxysulfosuccinimide esters (Harris, J. M., Herati, R. S. *Polym. Prepr.* (*Am. Chem. Soc., Div. Polym. Chem*), 32(1), 154-155 (1991); Herman, S., et al. *Macromol. Chem. Phys.* 195, 203-209 (1994); Roberts, M. J. et. al. *Advanced Drug Delivery Reviews*, 54, 459-476 (2002)). N-hydroxysuccinimide esters (NHS-esters and their water soluble analogs sulfo-NHS-esters) are commonly used for protein conjugation (see FIG. 2). NHS-esters yield stable amide products upon reaction with primary amines with relatively efficient coupling at physiological pH. The conjugation reactions are typically performed in 50-200 mM phosphate, bicarbonate/carbonate, HEPES or borate buffers (pH between 7 and 9) at 4° C. to room temperature from 0.5 to 2 hrs. NHS-esters are usually used at two- to 50-fold molar excess to protein. Typically, the concentration of the reagent can vary from 0.1-10 mM, while the optimal protein concentration is 50-100 µM.

In another method, given that XTEN polypeptides possess only a single N-terminal α-amino group, the XTEN can be engineered to contain additional ε-amino group(s) of intentionally incorporated lysine residues; exemplary sequences of which are provided in Table 3. The α- and ε-amino groups have different pKa values: approximately 7.6 to 8.0 for the α-amino group of the N-terminal amino acid, and approximately 10-10.5 for the ε-amino group of lysine. Such a significant difference in pKa values can be used for selective modification of amino groups. Deprotonation of all primary amines occurs at pH above pH 8.0. In this environment, the nucleophilic properties of different amines determine their reactivity. When deprotonated, the more nucleophilic ε-amino groups of lysines are generally more reactive toward electrophiles than α-amino groups. On the other hand, at a lower pH (for example pH 6), the more acidic α-amino groups are generally more deprotonated than ε-amino groups, and the order of reactivity is inverted. For example, the FDA-approved drug Neulasta (pegfilgranstim) is granulocyte colony-stimulating factor (G-CSF) modified by covalent attachment of 20 kDa PEG-aldehyde. Specific modification of the protein's N-terminal amino acid was accomplished by exploiting the lower pKa of α-amino group as compared to ε-amino groups of internal lysines (Molineaux, G. *Curr. Pharm. Des.* 10, 1235-1244 (2004), U.S. Pat. No. 5,824,784).

Figure 3:
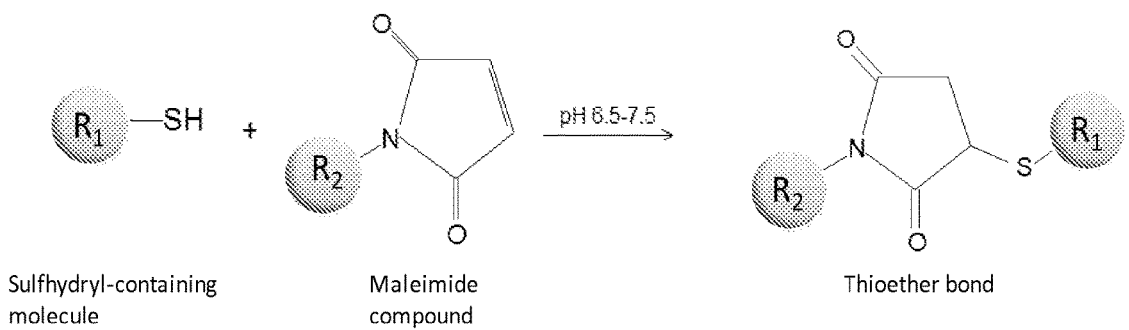
FIG. 3 shows a conjugation reaction utilizing thiol groups and an N-maleimide. The maleimide group reacts specifically with sulfhydryl groups when the pH of the reaction mixture is between pH 6.5 and 7.5, forming a stable thioether linkage that is not reversible.

The XTEN polypeptides comprising cysteine residues can be genetically engineered using recombinant methods described herein (see, e.g., Examples) or by standard methods known in the art. Conjugation to thiol groups can be carried using highly specific reactions, leading to the formation of single conjugate species joined by cross-linking agents. Functional groups suitable for reactions with cysteine thiol-groups are N-maleimides, haloacetyls, and pyridyl disulfides. The maleimide group reacts specifically with sulfhydryl groups when the pH of the reaction mixture is between pH 6.5 and 7.5, forming a stable thioether linkage that is not reversible (see FIG. 3). At neutral pH, maleimides react with sulfhydryls 1,000-fold faster than with amines, but when the pH is raised to greater than 8.5, the reaction favors primary amines. Maleimides do not react with tyrosines, histidines or methionines. For reaction solutions, thiols must be excluded from reaction buffers used with maleimides as they will compete for coupling sites. Excess maleimides in the reaction can be quenched at the end of a reaction by adding free thiols, while EDTA can be included in the coupling buffer to minimize oxidation of sulfhydryls.

Figure 4:
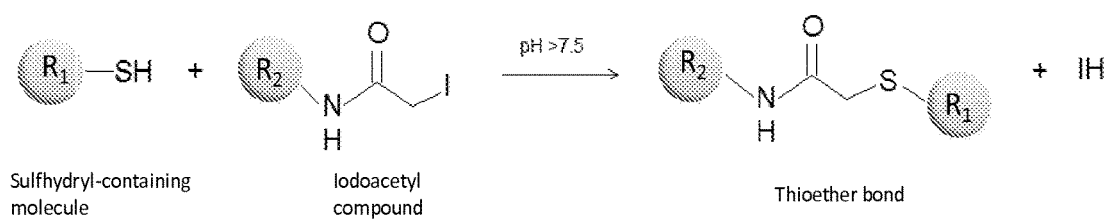
FIG. 4 shows a conjugation reaction utilizing haloacetyls. The most commonly used haloacetyl reagents contain an iodoacetyl group that reacts with sulfhydryl groups at physiological pH. The reaction of the iodoacetyl group with a sulfhydryl proceeds by nucleophilic substitution of iodine with a thiol producing a stable thioether linkage in the XTEN-payload.
Figure 5:
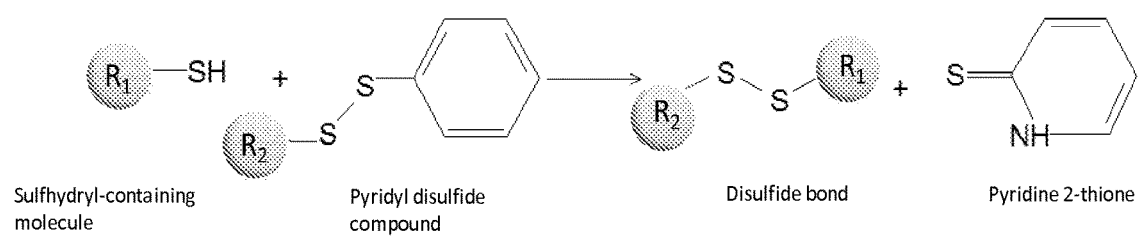
FIG. 5 shows a conjugation reaction utilizing pyridyl disulfides. Pyridyl disulfides react with sulfhydryl groups over a broad pH range (the optimal pH is 4-5) to form disulfide bonds linking XTEN to payloads.

In another embodiment, the invention contemplates use of haloacetyl reagents that are useful for cross-linking sulfhydryls groups of XTEN or payloads to prepare the subject conjugates. The most commonly used haloacetyl reagents contain an iodoacetyl group that reacts with sulfhydryl groups at physiological pH. The reaction of the iodoacetyl group with a sulfhydryl proceeds by nucleophilic substitution of iodine with a thiol producing a stable thioether linkage (see FIG. 4). Using a slight excess of the iodoacetyl group over the number of sulfhydryl groups at pH 8.3 ensures sulfhydryl selectivity. If a large excess of iodoacetyl group is used, the iodoacetyl group can react with other amino acids. Imidazoles can react with iodoacetyl groups at pH 6.9-7.0, but the incubation must proceed for longer than one week. Histidyl side chains and amino groups react in the unprotonated form with iodoacetyl groups above pH 5 and pH 7, respectively. In another embodiment, cross-linkers useful for sulfhydryls groups are pyridyl disulfides. Pyridyl disulfides react with sulfhydryl groups over a broad pH range (the optimal pH is 4-5) to form disulfide bonds linking XTEN to payloads (see FIG. 5). As a disulfide, conjugates prepared using these reagents are cleavable. During the reaction, a disulfide exchange occurs between the molecule's —SH group and the 2-pyridyldithiol group. As a result, pyridine-2-thione is released. These reagents can be used as crosslinkers and to introduce sulfhydryl groups into proteins. The disulfide exchange can be performed at physiological pH, although the reaction rate is slower.

The XTEN-payload conjugates comprising active synthetic peptides or polypeptides can be prepared using chemically active amino acid residues or their derivatives; e.g., the N-terminal α-amino group, the ε-amino group of lysine, a thiol group of cysteine, the carboxyl group of the C-terminal amino acid, a carboxyl group of aspartic acid or glutamic acid. Each peptide contains N-terminal α-amino group regardless of a primary amino acid sequence. If necessary, N-terminal α-amino group can be left protected/blocked upon chemical synthesis of the active peptide/polypeptide. The synthetic peptide/polypeptide may contain additional ε-amino group(s) of lysine that can be either natural or specifically substituted for conjugation. As described above, α- and ε-amino groups can be selectively modified at different pH. Another approach to selectively modify either α- or ε-amino group in a synthetic peptide is a reversible protection of amino groups with Di-tert-butyl dicarbonate (BOC$_2$). For example, selective BOC protection of vapreotide peptide (a synthetic somatostatin analog) has been achieved by modification at pH 6 (α-group protected) or pH 8.5 (ε-group protected). The remaining free amino group was then specifically modified by PEG-N-hydroxysuccinimide or PEG-aldehyde. Finally, BOC protection was removed by acidic treatment to yield mono-modified peptides (Morpurgo, M. et al. Selective Alkylation and Acylation of α and ε Amino Groups with PEG in a Somatostatin Analogue: Tailored Chemistry for Optimized Bioconjugates. *Bioconjugate Chem*. 2002. 13:1238-1243).

Since cysteines are generally less abundant in natural peptide and protein sequences than lysines, the use of cysteines as a site for conjugation reduces the likelihood of multiple conjugations to XTEN-cross-linker molecules in a reaction. It also reduces the likelihood of peptide/protein deactivation upon conjugation. Moreover, conjugation to cysteine sites can often be carried out in a well-defined manner, leading to the formation of single species XTEN polymer-peptide or XTEN polymer-polypeptide conjugates. In some cases cysteine may be absent in the amino acid sequence of the peptide to be conjugated. In such a case, cysteine residue can be added to the N- or C-terminus of the peptide either recombinantly or synthetically using standard methods. Alternatively, a selected amino acid can be chemically or genetically modified to cysteine. As one example, serine modification to cysteine is considered a conservative mutation. Another approach to introduce a thiol group in cysteine-lacking peptides is chemical modification of the lysine ε-amino group using thiolating reagents such as 2-iminothiolane (Traut's reagent), SATA (N-succinimidyl S-acetylthioacetate), SATP (N-succinimidyl S-acetylthiopropionate), SAT-PEO$_4$-Ac (N-Succinimidyl S-acetyl(thiotetraethylene glycol)), SPDP (N-Succinimidyl 3-(2-pyridyldithio)propionate), LC-SPDP (Succinimidyl 6-(3'-[2-pyridyldithio]propionamido)hexanoate) (described more fully, below). Once a unique thiol group is introduced in the peptide, it can be selectively modified by compounds containing sufhydryl-reactive such as N-maleimides, haloacetyls, and pyridyl disulfides, as described above.

The conjugation between the XTEN polypeptide and a peptide, protein or small molecule drug payload may be achieved by a variety of linkage chemistries, including commercially available zero-length, homo- or hetero-bifunctional, and multifunctional cross-linker compounds, according to methods known and available in the art, such as those described, for example, in R. F. Taylor (1991) "Protein immobilization. Fundamentals and Applications", Marcel Dekker Inc., N.Y.; G. T. Hermanson et al. (1992) "Immobilized Affinity Ligand Techniques", Academic Press, San Diego; G. T. Hermanson (2008) "Bioconjugate Techniques", 2$^{nd}$. ed. Elsevier, Inc., S. S. Wong (1991) "Chemistry of Protein Conjugation and Crosslinking", CRC Press, Boca Raton. Suitable cross-linking agents for use in preparing the conjugates of the disclosure are commercially-available from companies like Sigma-Aldrich, Thermo Fisher Scientific (Pierce Protein Research Products), Invitrogen, ProteoChem, G-Biosciences. Preferred embodiments of cross-linkers comprise a thiol-reactive functional group or an amino-reactive functional group. A list of exemplary cross-linkers is provided in Table 13.

TABLE 13

Exemplary cross-linkers
Cross-linker maleimides, haloacetyls, pyridyl disulfides, haloacetyls, pyridyl disulfides, ABH (p-Azidobenzoyl hydrazide), AMAS (N-(α-Maleimidoacetoxy)-succinimide ester), ANB-NOS (N-5-Azido-2-nitrobenzyloxy-succinimide), APDP (N-(4-[p-Azidosalicylamido]butyl)-3'-(2'-pyridyldithio) propionamide), ASBA (4-(p-Azidosalicylamido)-butylamine), BASED (Bis (β-[4-azidosalicylamido]ethyl) disulfide), BMB (1,4-Bis-Maleimidobutane), BMDB (1,4 Bismaleimidyl-2,3-dihydroxybutane), BMH (Bis-Maleimidohexane), BMOE (Bis-Maleimidoethane), BMPH (N-(β-Maleimidopropionic acid)hydrazide), BMPS (N-(β-Maleimidopropyloxy)succinimide ester), BM(PEG)$_2$ (1,8-Bis-Maleimidodiethylene-glycol), BM(PEG)$_3$ (1,11-Bis-Maleimidotriethyleneglycol), BS$^2$G (Bis (sulfosuccinimidyl)glutarate), BS$^3$ (Sulfo-DSS) (Bis (sulfosuccinimidyl)suberate), BS[PEG]$_5$ (Bis (NHS)PEG5), BS(PEG)$_9$ (Bis (NHS)PEG9), BSOCOES (Bis(2-[succinimidoxycarbonyloxy]ethyl)sulfone), C6-SANH (C6-Succinimidyl 4-hydrazinonicotinate acetone hydrazone), C6-SFB (C6-Succinimidyl 4-formylbenzoate), DCC (N,N-Dicyclohexylcarbodiimide), DFDNB (1-5-Difluoro-2,4-dinitrobenzene), DMA (Dimethyl adipimidate), DMP (Dimethyl pimelimidate), DMS (Dimethyl suberimidate), DPDPB (1,4-Di-(3'-[2'pyridyldithio]propionamido) butane), DSG (Disuccinimidyl glutarate), DSP (Dithiobis(succinimidylpropionate), Lomant's Reagent), DSS (Disuccinimidyl suberate), DST (Disuccinimidyl tartarate), DTBP (Dimethyl 3,3'-dithiobispropionimidate), DTME (Dithiobis-maleimidoethane), DTSSP (Sulfo-DSP) (3,3'-Dithiobis (sulfosuccinimidylpropionate)), EDC (1-Ethyl-3-(3-dimethylaminopropyl) carbodiimide hydrochloride), EGS (Ethylene glycol bis(succinimidylsuccinate)), EMCA (N-ε-Maleimidocaproic acid), EMCH (N-(ε-Maleimidocaproic acid)hydrazide), EMCS (N-(ε-Maleimidocaproyloxy)succinimide ester), GMBS (N-(γ-Maleimidobutyryloxy)succinimide ester), KMUA (N-κ-Maleimidoundecanoic acid), KMUH (N-(κ-Maleimidoundecanoic acid)hydrazide), LC-SDA (NHS-LC-Diazirine), LC-SMCC (Succinimidyl 4-(N-maleimidomethyl) cyclohexane-1-carboxy-(6-amidocaproate)), LC-SPDP (Succinimidyl 6-(3'-[2-pyridyldithio]propionamido)hexanoate), MBS (m-Maleimidobenzoyl-N-hydroxysuccinimide ester), MPBH (4-(4-N-Maleimidophenyl)-butyric acid hydrazide), NHS-ASA (N-Hydroxysuccinimidyl-4-azidosalicylic acid), PDPH (3-(2-Pyridyldithio)propionylhydrazide), PMPI (N-(p-Maleimidophenyl)isocyanate), SADP (Succinimidyl (4-azidophenyl dithio) propionate), SAED (Succinimidyl 2-[7-azido-4-methylcoumarin-3-acetamido]ethyl-1,3'-dithiopropionate), SAND (Succinimidyl-2-(m-azido-o-nitrobenzamido)ethyl 1,3'-dithiopropionate), SANH (Succinimidyl 4-hydrazinonicotinate acetone hydrazone), SANPAH (N-Succinimidyl 6-(4'-azido-2'-nitrophenylamino)hexanoate), SASD (Succinimidyl-2-(p-azidosalycylamido)ethyl-1,3-dithiopropionate), SBAP (Succinimdyl 3-(bromoacetamido)propionate), SDA (NHS-Diazirine), SDAD (NHS-SS-Diazirine), SFAD (Succinimidyl(perfluoroazidobenzamido)ethyl 1,3'-dithiopropionate), SFB (Succinimidyl 4-formylbenzoate), SHTH (Succinimidyl 4-hydrazidoterephthalate), SIA (N-succinimidyl iodoacetate), SIAB (N-Succinimidyl(4-iodoacetyl)aminobenzoate), SMPB (Succinimidyl 4-(p-maleimidophenyl) butyrate), SMCC (Succinimidyl 4-(N-maleimido-methyl)cyclohexane-1-carboxylate), SM[PEG]$_2$ (NHS-PEG2-Maliemide), SM[PEG]$_4$ (NHS-PEG4-Maliemide), SM(PEG)$_6$ (NHS-PEG6-Maliemide), SM[PEG]$_8$ (NHS-PEG8-Maliemide), SM[PEG]$_{12}$ (NHS-

TABLE 13-continued

Exemplary cross-linkers
Cross-linker

PEG12-Maliemide), SM(PEG)$_{24}$ (NHS-PEG24-Maleimide), SMPB (Succinimidyl 4-(p-maleimido-phenyl)butyrate), SMPH (Succinimidyl-6-(β-maleimidopropionamido)hexanoate), SMPT (4-Succinimidyloxycarbonyl-methyl-α-(2-pyridyldithio)toluene), SPB (Succinimidyl-(4-psoralen-8-yloxy)butyrate), SPDP (N-Succinimidyl 3-(2-pyridyldithio)propionate), Sulfo-DST (Sulfodisuccinimidyl tartrate), Sulfo-EGS (Ethylene glycol bis (sulfo-succinimidyl succinate)), Sulfo-EMCS (N-(ε-Maleimidocaproyloxy)sulfosuccinimide ester), Sulfo-GMBS (N-(γ-Maleimidobutryloxy)sulfosuccinimide ester), Sulfo-HSAB (N-Hydroxysulfosuccinimidyl-4-azidobenzoate), Sulfo-KMUS (N-(κ-Maleimidoundecanoyloxy)sulfosuccinimide ester), Sulfo-LC-SDA (Sulfo-NHS-LC-Diazirine), Sulfo-LC-SMPT (Sulfosuccinimidyl 6-(α-methyl-α-[2-pyridyldithio]-toluamido)hexanoate), Sulfo-LC-SPDP (Sulfosuccinimidyl 6-(3'-[2-pyridyldithio]propionamido)hexanoate), Sulfo-MBS (m-Maleimidobenzoyl-N-hydroxysulfosuccinimide ester), Sulfo-NHS-LC-ASA (Sulfosuccinimidyl(4-azido-salicylamido) hexanoate), Sulfo-SADP (Sulfosuccinimidyl (4-azidophenyl dithio) propionate), Sulfo-SAED (Sulfosuccimidyl 2-[7-azido-4-methylcoumarin-3-acetamido]ethyl-1,3'-dithiopropionate), Sulfo-SAND (Sulfosuccinimidyl-2-(m-azido-o-nitrobenzamido)ethyl 1,3'-dithiopropionate), Sulfo-SANPAH (Sulfosuccinimidyl 6-(4'-azido-2'-nitrophenylamino)hexanoate), Sulfo-SASD (Sulfosuccinimidyl-2-(p-azidosalycylamido)ethyl-1,3-dithiopropionate), Sulfo-SDA (Sulfo-NHS-Diazirine), Sulfo-SDAD (Sulfo-NHS-SS-Diazirine), Sulfo-SFAD (Sulfosuccinimidyl(perfluoroazidobenzamido)ethyl 1,3'-dithiopropionate), Sulfo-SIAB (Sulfosuccinimidyl(4-iodo-acetyl)aminobenzoate), Sulfo-SMCC (Sulfosuccinimidyl 4-(N-maleimidomethyl)cyclohexane-1-carboxylate), Sulfo-SMPB (Sulfosuccinimidyl 4-(p-maleimidophenyl)butyrate), THPP (β-(Tris[hydroxymethyl]phosphine)propionic acid (betaine)), TMEA (Tris-(2-Maleimidoethyl)amine), TSAT (Tris-(succinimidyl aminotriacetate)), 3-propargyloxypropanoic acid,NHS ester, acetylene-PEG-NHS ester, dibenzylcyclooctyne, (DBCO)-NHS ester, DBCO-PEG-NHS ester, cyclooctyne (COT)-NHS ester, COT-PEG-NHS ester, COT-PEG-pentafluorophenyl (PFP) ester, BCOT-NHS ester, BCOT-PEG-NHS ester, BCOT-PEG-pentafluorophenyl (PFP) ester, Acetylene-PEG4-maleimide, DBCO-maleimide, COT-maleimide, BCOT-maleimide, 3-azide-propionic acid, NHS ester, 6-azide-hexanoic acid, NHS ester, 3-azide-propionic acid, PFP ester, 6-azide-hexanoic acid, PFP ester, azide-PEG-NHS ester, azide-PEG-PFP ester, azide-PEG-maleimide, N-(5-Aminopentyl)maleimide, aminopentyl-maleimide Non-limiting examples of cross-linkers are ABH (p-Azidobenzoyl hydrazide), AMAS (N-(α-Maleimidoacetoxy)-succinimide ester), ANB-NOS (N-5-Azido-2-nitrobenzyloxy-succinimide), APDP (N-(4-[p-Azidosalicylamido] butyl)-3'-(2'-pyridyldithio) propionamide), ASBA (4-(p-Azidosalicylamido)-butylamine), BASED (Bis (β-[4-azidosalicylamido]ethyl) disulfide), BMB (1,4-Bis-Maleimidobutane), BMDB (1,4 Bismaleimidyl-2,3-dihydroxybutane), BMH (Bis-Maleimidohexane), BMOE (Bis-Maleimidoethane), BMPH (N-(β-Maleimidopropionic acid)hydrazide), BMPS (N-(β-Maleimidopropyloxy)succinimide ester), BM(PEG)$_2$ (1,8-Bis-Maleimidodiethylene-glycol), BM(PEG)$_3$ (1,11-Bis-Maleimidotriethyleneglycol), BS$^2$G (Bis (sulfosuccinimidyl)glutarate), BS$^3$ (Sulfo-DSS) (Bis (sulfosuccinimidyl)suberate), BS[PEG]$_5$ (Bis (NHS) PEG5), BS(PEG)$_9$ (Bis (NHS)PEG9), BSOCOES (Bis(2-[succinimidoxycarbonyloxy]ethyl)sulfone), C6-SANH (C6-Succinimidyl 4-hydrazinonicotinate acetone hydrazone), C6-SFB (C6-Succinimidyl 4-formylbenzoate), DCC (N,N-Dicyclohexylcarbodiimide), DFDNB (1-5-Difluoro-2,4-dinitrobenzene), DMA (Dimethyl adipimidate), DMP (Dimethyl pimelimidate), DMS (Dimethyl suberimidate), DPDPB (1,4-Di-(3'-[2'pyridyldithio]propionamido) butane), DSG (Disuccinimidyl glutarate), DSP (Dithiobis(succinidylpropionate), Lomant's Reagent), DSS (Disuccinimidyl suberate), DST (Disuccinimidyl tartarate), DTBP (Dimethyl 3,3'-dithiobispropionimidate), DTME (Dithiobis-maleimidoethane), DTSSP (Sulfo-DSP) (3,3'-Dithiobis (sulfosuccinimidylpropionate)), EDC (1-Ethyl-3-(3-dimethylaminopropyl) carbodiimide hydrochloride), EGS (Ethylene glycol bis(succinimidylsuccinate)), EMCA (N-ε-Maleimidocaproic acid), EMCH (N-(ε-Maleimidocaproic acid)hydrazide), EMCS (N-(ε-Maleimidocaproyloxy)succinimide ester), GMBS (N-(γ-Maleimidobutyryloxy)succinimide ester), KMUA (N-κ-Maleimidoundecanoic acid), KMUH (N-(κ-Maleimidoundecanoic acid)hydrazide), LC-SDA (NHS-LC-Diazirine), LC-SMCC (Succinimidyl 4-(N-maleimidomethyl) cyclohexane-1-carboxy-(6-amidocaproate)), LC-SPDP (Succinimidyl 6-(3'-[2-pyridyldithio]propionamido)hexanoate), MBS (m-Maleimidobenzoyl-N-hydroxysuccinimide ester), MPBH (4-(4-N-Maleimidophenyl)-butyric acid hydrazide), NHS-ASA (N-Hydroxysuccinimidyl-4-azidosalicylic acid), PDPH (3-(2-Pyridyldithio) propionylhydrazide), PMPI (N-(p-Maleimidophenyl) isocyanate), SADP (Succinimidyl (4-azidophenyl dithio) propionate), SAED (Succimidyl 2-[7-azido-4-methylcoumarin-3-acetamido]ethyl-1,3'-dithiopropionate), SAND (Succinimidyl-2-(m-azido-o-nitrobenzamido)ethyl 1,3'-dithiopropionate), SANH (Succinimidyl 4-hydrazinonicotinate acetone hydrazone), SANPAH (N-Succinimidyl 6-(4'-azido-2'-nitrophenylamino)hexanoate), SASD (Succinimidyl-2-(p-azidosalycylamido)ethyl-1,3-dithiopropionate), SBAP (Succinmdyl 3-(bromoacetamido)propionate), SDA (NHS-Diazirine), SDAD (NHS-SS-Diazirine), SFAD (Succinimidyl(perfluoroazidobenzamido)ethyl 1,3'-dithiopropionate), SFB (Succinimidyl 4-formylbenzoate), SHTH (Succinimidyl 4-hydrazidoterephthalate), SIA (N-succinimidyl iodoacetate), SIAB (N-Succinimidyl(4-iodoacetyl)aminobenzoate), SMPB (Succinimidyl 4-(p-maleimidophenyl) butyrate), SMCC (Succinimidyl 4-(N-maleimido-methyl)cyclohexane-1-carboxylate), SM[PEG]$_2$ (NHS-PEG2-Maliemide), SM[PEG]$_4$ (NHS-PEG4-Maliemide), SM(PEG)$_6$ (NHS-PEG6-Maleimide), SM[PEG]s (NHS-PEG8-Maleimide), SM[PEG]$_{12}$(NHS-PEG12-Maliemide), SM(PEG)$_{24}$ (NHS-PEG24-Maleimide), SMPB (Succinimidyl 4-(p-maleimido-phenyl)butyrate), SMPH (Succinimidyl-6-(j-maleimidopropionamido) hexanoate), SMPT (4-Succinimidyloxycarbonyl-methyl-α-(2-pyridyldithio)toluene), SPB (Succinimidyl-(4-psoralen-8-yloxy)butyrate), SPDP (N-Succinimidyl 3-(2- pyridyldithio)propionate), Sulfo-DST (Sulfodisuccinimidyl tartrate), Sulfo-EGS (Ethylene glycol bis (sulfo-succinimidyl succinate)), Sulfo-EMCS (N-(ε-Maleimidocaproyloxy) sulfosuccinimide ester), Sulfo-GMBS (N-(γ-Maleimidobutryloxy)sulfosuccinimide ester), Sulfo-HSAB (N-Hydroxysulfosuccinimidyl-4-azidobenzoate), Sulfo-KMUS (N-(κ-Maleimidoundecanoyloxy)sulfosuccinimide ester), Sulfo-LC-SDA (Sulfo-NHS-LC-Diazirine), Sulfo-LC-SMPT (Sulfosuccinimidyl 6-(α-methyl-α-[2-pyridyldithio]-toluamido)hexanoate), Sulfo-LC-SPDP (Sulfosuccinimidyl 6-(3'-[2-pyridyldithio]propionamido)hexanoate), Sulfo-MBS (m-Maleimidobenzoyl-N-hydroxysulfosuccinimide ester), Sulfo-NHS-LC-ASA (Sulfosuccinimidyl(4-azido-salicylamido) hexanoate), Sulfo-SADP (Sulfosuccinimidyl (4-azidophenyl dithio) propionate), Sulfo-SAED (Sulfosuccimidyl 2-[7-azido-4-methylcoumarin-3-acetamido]ethyl-1,3'-dithiopropionate), Sulfo-SAND (Sulfosuccinimidyl-2-(m-azido-o-nitrobenzamido)ethyl 1,3'-dithiopropionate), Sulfo-SANPAH (Sulfosuccinimidyl 6-(4'-azido-2'-nitrophenylamino)hexanoate), Sulfo-SASD (Sulfosuccinimidyl-2-(p-azidosalycylamido)ethyl-1,3-dithiopropionate), Sulfo-SDA (Sulfo-NHS-Diazirine), Sulfo-SDAD (Sulfo-NHS-SS-Diazirine), Sulfo-SFAD (Sulfosuccinimidyl(perfluoroazidobenzamido)ethyl 1,3'-dithiopropionate), Sulfo-SIAB (Sulfosuccinimidyl(4-iodoacetyl)aminobenzoate), Sulfo-SMCC (Sulfosuccinimidyl 4-(N-maleimidomethyl)cyclohexane-1-carboxylate), Sulfo-SMPB (Sulfosuccinimidyl 4-(p-maleimidophenyl)butyrate), THPP (β-(Tris[hydroxymethyl]phosphine)propionic acid (betaine)), TMEA (Tris-(2-Maleimidoethyl)amine), TSAT (Tris-(succinimidyl aminotriacetate)).

Figure 6:
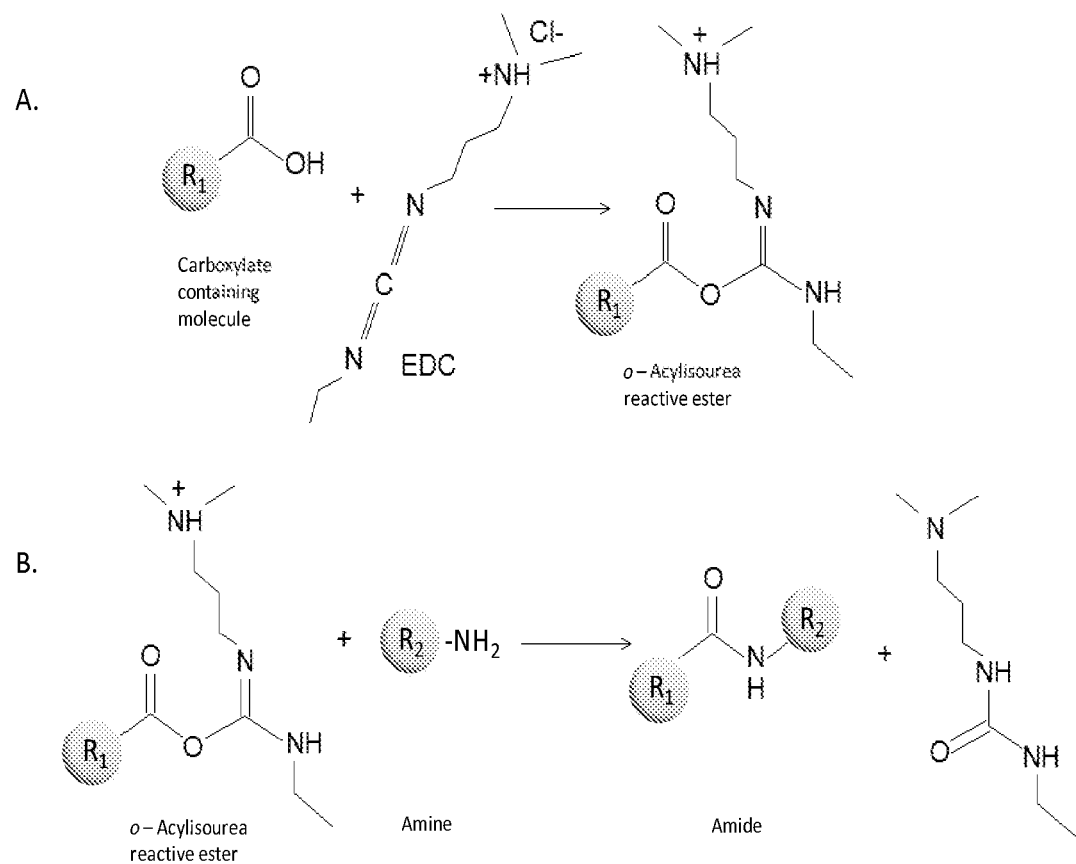
FIG. 6 shows a conjugation reaction utilizing zero-length cross-linkers wherein the cross-linkers are used to directly conjugate carboxyl functional groups of one molecule (such as a payload) to the primary amine of another molecule (such as an XTEN).

In some embodiments, XTEN-payload conjugates using cross-linking reagents introduce non-natural spacer arms. However, in cases where a native peptide bond is preferred, the invention provides that a reaction can be carried out using zero-length cross-linkers that act via activation of a carboxylate group. In the embodiments thereof, in order to achieve reaction selectivity, the first polypeptide has to contain only a free C-terminal carboxyl group while all lysine, glutamic acid and aspartic acid side chains are protected and the second peptide/protein N-terminal α-amine has to be the only available unprotected amino group (requiring that any lysines, asparagines or glutamines be protected). In such cases, use of XTEN AG family sequences of Table 2 that are without glutamic acid as the first polypeptide in the XTEN-payload or XTEN-cross-linker is preferred. Accordingly, in one embodiment, the invention provides XTEN-cross-linker and XTEN-payload comprising AG XTEN sequences wherein the compositions are conjugated to payloads using a zero-length cross-linkers. Exemplary zero-length cross-linkers utilized in the embodiment include but are not limited to DCC (N,N-Dicyclohexylcarbodiimide) and EDC (1-Ethyl-3-(3-dimethylaminopropyl) carbodiimide hydrochloride) wherein the cross-linkers are used to directly conjugate carboxyl functional groups of one molecule (such as a payload) to the primary amine of another molecule, such as a payload with that functional group (see FIG. 6). Sulfo-NHS (N-hydroxysulfosuccinimide) and NHS (N-hydroxysuccinimide) are used as catalysts for conjugation, increasing reaction efficiency (Grabarek Z, Gergely J. Zero-length crosslinking procedure with the use of active esters. (1990) Anal. Biochem. 185(1), 131-135). EDC reacts with carboxylic acid group and activates the carboxyl group to form an active O-acylisourea intermediate, allowing it to be coupled to the amino group in the reaction mixture. The O-acylisourea intermediate is unstable in aqueous solutions, making it ineffective in two-step conjugation procedures without increasing the stability of the intermediate using N-hydroxysuccinimide. This intermediate reacts with a primary amine to form an amide derivative. The crosslinking reaction is usually performed between pH 4.5 to 5 and requires only a few minutes for many applications. However, the yield of the reaction is similar at pH from 4.5 to 7.5. The hydrolysis of EDC is a competing reaction during coupling and is dependent on temperature, pH and buffer composition. 4-Morpholinoethanesulfonic acid (MES) is an effective carbodiimide reaction buffer. Phosphate buffers reduce the reaction efficiency of the EDC, but increasing the amount of EDC can compensate for the reduced efficiency. Tris, glycine and acetate buffers may not be used as conjugation buffers.

The invention also provides compositions in which three XTENs are linked by trivalent cross-linkers, resulting in trimeric XTEN-cross-linker conjugates. Trimeric cross-linkers can be created by connecting a symmetric trivalent core such as tertiary amine, trisubstituted methane or 1,3,5-trisubstituted benzene or asymmetric trivalent molecule such a LysLys dipeptide or a GluGlu dipeptide or a AspAsp dipeptide or a CysCysCys tripeptide by spacers with various reactive side groups described in Table 14, using standard conjugation techniques. In one embodiment, the invention provides compositions in which three XTENs are covalently linked by a trivalent cross-linker selected from the group consisting of thiol-reactive Tris-(2-Maleimidoethyl)amine (TMEA), amine-reactive Tris-(succimimidyl aminotricetate) (TSAT) and the cross-linkers set forth in Table 14.

TABLE 14

Trivalent Cross-linkers
Trivalent Cross-linker*

| Trivalent Core | Group 1 | Group 2 | Group 3 |
| --- | --- | --- | --- |
| Tertiary amine | Azide | Azide | Azide |
| Trisubstituted methane | Alkyne | Alkyne | Alkyne |
| 1,3,5-trisubstituted benzene | NHS | NHS | NHS |
| | Maleimide | Maleimide | Maleimide |
| | Iodoacetyl | Iodoacetyl | Iodoacetyl |
| | Azide | NHS | NHS |
| LysLys | Azide | Azide | NHS |
| GluGluGlu | Azide | Iodoacetyl | Iodoacetyl |
| AspAspAsp | Azide | Azide | Iodoacetyl |
| CysCysCys | Alkyne | NHS | NHS |
| | Alkyne | Alkyne | NHS |
| | Alkyne | Iodoacetyl | Iodoacetyl |
| | Alkyne | Alkyne | Iodoacetyl |
| | Alkyne | Maleimide | Maleimide |
| | Alkyne | Alkyne | Maleimide |
| | NHS | Maleimide | Maleimide |
| | NHS | NHS | Maleimide |
| | NHS | Alkyne | Maleimide |

*One of the trivalent core + any one of Group 1 + any one of Group 2 + any one of Group 3

In other embodiments, XTEN and payloads can be conjugated using a broad group of cross-linkers, including those consisting of a spacer arm (linear or branched) and two or more reactive ends that are capable of attaching to specific functional groups (e.g., primary amines, sulfhydryls, etc.) on proteins or other molecules. Linear cross-linkers can be homobifunctional or heterobifunctional. Homobifunctional cross-linkers have two identical reactive groups which are used to cross-link proteins in one step reaction procedure. Non-limiting examples of amine-reactive homobifunctional cross-linkers are BS2G (Bis (sulfosuccinimidyl)glutarate), BS3 (Sulfo-DSS) (Bis (sulfosuccinimidyl)suberate), BS[PEG]5 (Bis (NHS)PEG5), BS(PEG)9 (Bis (NHS) PEG9), BSOCOES (Bis(2-[succinimidoxycarbonyloxy]

ethyl)sulfone), DFDNB (1-5-Difluoro-2,4-dinitrobenzene), DMA (Dimethyl adipimidate), DMP (Dimethyl pimelimidate), DMS (Dimethyl suberimidate), DSG (Disuccinimidyl glutarate), DSP (Dithiobis(succimidylpropionate) (Lomant's Reagent), DSS (Disuccinimidyl suberate), DST (Disuccinimidyl tartarate), DTBP (Dimethyl 3,3'-dithiobispropionimidate), DTSSP (Sulfo-DSP) (3,3'-Dithiobis(sulfosuccinimidylpropionate)), EGS (Ethylene glycol bis(succinimidylsuccinate)), Sulfo-EGS (Ethylene glycol bis(sulfo-succinimidyl succinate)).

Additionally, examples of homobifunctional cross-linkers employed in the compositions and in the methods to create the XTEN-payload and/or XTEN-cross-linker compositions are sulfhydryl-reactive agents such as BMB (1,4-Bis-Maleimidobutane), BMH (Bis-Maleimidohexane), BMDB (1,4 Bismaleimidyl-2,3-dihydroxybutane), BMOE (Bis-Maleimidoethane), BM(PEG)2 (1,8-Bis-Maleimidodiethyleneglycol), BM(PEG)3 (1,11-Bis-Maleimidotriethyleneglycol), DPDPB (1,4-Di-(3'-[2'pyridyldithio]propionamido) butane), DTME (Dithiobis-maleimidoethane).

For the creation of XTEN-cross-linker conjugates for subsequent conjugation to payloads, as well as the creation of XTEN-payload conjugates, heterobifunctional cross-linkers are preferred as the sequential reactions can be controlled. As heterobifunctional cross-linkers possess two different reactive groups, their use in the compositions allows for sequential two-step conjugation. A heterobifunctional reagent is reacted with a first protein using the more labile group. In one embodiment, the conjugation of the heterobifunctional cross-linker to a reactive group in an XTEN results in an XTEN-cross-linker conjugate. After completing the reaction and removing excess unreacted cross-linker, the modified protein (such as the XTEN-cross-linker) can be added to the payload which interacts with a second reactive group of the cross-linker, resulting in an XTEN-payload conjugate. Most commonly used heterobifunctional cross-linkers contain an amine-reactive group at one end and a sulfhydryl-reactive group at the other end. Accordingly, these cross-linkers are suitable for use with cysteine- or lysine-engineered XTEN, or with the alpha-amino group of the N-terminus of the XTEN. Non-limiting examples of heterobifunctional cross-linkers are AMAS (N-(α-Maleimidoacetoxy)-succinimide ester), BMPS (N-(β-Maleimidopropyloxy)succinimide ester), EMCS (N-(ε-Maleimidocaproyloxy)succinimide ester), GMBS (N-(γ-Maleimidobutyryloxy)succinimide ester), LC-SMCC (Succinimidyl 4-(N-maleimidomethyl) cyclohexane-1-carboxy-(6-amidocaproate)), LC-SPDP (Succinimidyl 6-(3'-[2-pyridyldithio]propionamido)hexanoate), MBS (m-Maleimidobenzoyl-N-hydroxysuccinimide ester), SBAP (Succinimdyl 3-(bromoacetamido)propionate), SIA (N-succinimidyl iodoacetate), SIAB (N-Succinimidyl(4-iodoacetyl)aminobenzoate), SMPB (Succinimidyl 4-(p-maleimidophenyl) butyrate), SMCC (Succinimidyl 4-(N-maleimidomethyl)cyclohexane-1-carboxylate), SM[PEG]$_2$(NHS-PEG2-Maliemide), SM[PEG]$_4$ (NHS-PEG4-Maliemide), SM(PEG)$_6$ (NHS-PEG6-Maleimide), SM[PEG]s (NHS-PEG8-Maliemide), SM[PEG]$_{12}$(NHS-PEG12-Maliemide), SM(PEG)$_{24}$ (NHS-PEG24-Maleimide), SMPB (Succinimidyl 4-(p-maleimido-phenyl)butyrate), SMPH (Succinimidyl-6-(maleimidopropionamido)hexanoate), SMPT (4-Succinimidyloxycarbonyl-methyl-α-(2-pyridyldithio)toluene), SPDP (N-Succinimidyl 3-(2-pyridyldithio)propionate), Sulfo-EMCS (N-(s-Maleimidocaproyloxy)sulfosuccinimide ester), Sulfo-GMBS (N-(γ-Maleimidobutryloxy)sulfosuccinimide ester), Sulfo-KMUS (N-(κ-Maleimidoundecanoyloxy)sulfosuccinimide ester), Sulfo-LC-SMPT (Sulfosuccinimidyl 6-(α-methyl-α-[2-pyridyldithio]-toluamido) hexanoate), Sulfo-LC-SPDP (Sulfosuccinimidyl 6-(3'-[2-pyridyldithio]propionamido)hexanoate), Sulfo-MBS (m-Maleimidobenzoyl-N-hydroxysulfosuccinimide ester), Sulfo-SIAB (Sulfosuccinimidyl(4-iodo-acetyl)aminobenzoate), Sulfo-SMCC (Sulfosuccinimidyl 4-(N-maleimidomethyl)cyclohexane-1-carboxylate), Sulfo-SMPB (Sulfosuccinimidyl 4-(p-maleimidophenyl)butyrate). An example of a heterobifunctional cross-linker that allows covalent conjugation of amine- and sulfhydryl-containing molecules is Sulfo-SMCC (SulfoSulfosuccinimidyl 4-(N-maleimidomethyl)cyclohexane-1-carboxylate). Sulfo-SMCC is a water soluble analog of SMCC that can be prepared in aqueous buffers up to 10 mM concentration. The cyclohexane ring in the spacer arm of this cross-linker decreases the rate of hydrolysis of the maleimide group compared to similar reagents not containing this ring. This feature enables XTEN that have been maleimide-activated with SMCC or Sulfo-SMCC to be lyophilized and stored for later conjugation to a sulfhydryl-containing molecule. Thus, in one embodiment, the invention provides an XTEN-cross-linker having an XTEN having at least about 80% sequence identity, or at least about 90%, or about 91%, or about 92%, or about 93%, or about 94%, or about 95%, or about 96%, or about 97%, or about 98%, or about 99% sequence identity, or is identical to a sequence or a fragment of a sequence selected from of Table 3, when optimally aligned, wherein XTEN-cross-linker has one or more cross-linkers of sulfo-SMCC linked to the α-amino group of the XTEN or the ε-amine of a lysine-engineered XTEN. In another embodiment, the invention provides an XTEN-cross-linker having an XTEN having at least about 80% sequence identity, or at least about 90%, or about 91%, or about 92%, or about 93%, or about 94%, or about 95%, or about 96%, or about 97%, or about 98%, or about 99% sequence identity, or is identical to a sequence or a fragment of a sequence selected from of Table 2, when optimally aligned, wherein the XTEN-cross-linker has one sulfo-SMCC linked to the amino group of the N-terminus of the XTEN. The foregoing described heterobifunctional cross-linkers conjugate two molecules via a single amine and a single cysteine. A special type of cross-linker was developed for site-specific conjugation to disulfide bridges in proteins (Balan S. et al. Site-specific PEGylation of protein disulfide bonds using a three-carbon bridge. (2007) Bioconjugate Chem. 18, 61-76; Brocchini S. et al. Disulfide bridge based PEGylation of proteins. (2008) Advanced Drug Delivery Reviews 60, 3-12). First, the linker is synthesized as an amine-specific 4-[2,2-bis[p-tolylsulfonyl)methyl]acetyl) benzoic acid-NHS ester. This molecule can be covalently attached to the amino group of XTEN yielding XTEN-Bis(sulfone). Incubation of the latter molecule in 50 mM sodium phosphate buffer, pH 7.8, will result in elimination of toluene sulfinic acid to generate XTEN-α, β-unsaturated β'-monosulfone. The resulting molecule will react with a disulfide bridge-containing payload protein in a site-specific manner. In a first step the disulfide bridge is converted into two thiols by reduction. In a second step, the XTEN-monosulfone bis-alkylates two cysteines resulting in a chemically-stable three-carbon bridge. The same α,β-unsaturated β'-monosulfone can be used not only for conjugation to two thiol groups derived from a disulfide bridge but also for conjugation to polyhistidine tags (Cong Y. et al. Site-specific PEGylation at histidine tags. (2012) Bioconjugate Chem. 23, 248-263).

Conjugation using XTEN-cross-linker compositions with the sulfo-SMCC is usually performed in a two-step process. In one embodiment, the amine-containing protein is prepared in conjugation buffer of, e.g., phosphate-buffered saline (PBS=100 mM sodium phosphate, 150 mM sodium chloride, pH 7.2) or a comparable amine- and sulfhydryl-free buffer at pH 6.5-7.5. The addition of EDTA to 1-5 mM helps to chelate divalent metals, thereby reducing disulfide formation in the sulfhydryl-containing protein. The concentration of the amine-containing protein determines the cross-linker molar excess to be used. In general, in protein samples of <1 mg/ml utilize an 40-80-fold molar excess, protein samples of 1-4 mg/ml utilize a 20-fold molar excess, and protein samples of 5-10 mg/ml utilize a 5- to 10-fold molar excess of the cross-linker. The reaction mixture (amine-containing protein and cross-linker) is incubated for 30 minutes at room temperature or 2 hours at 4° C. and then the excess cross-linker is removed using a desalting column equilibrated with conjugation buffer. In the case of preparing a XTEN-cross-linker, the composition would be held at that point. In embodiments wherein the XTEN-cross-linker is conjugated to a payload, the sulfhydryl-containing payload and the XTEN-cross-linker conjugate are mixed in a molar ratio corresponding to that desired for the final conjugate (taking into account the number of expected cross-linkers conjugated to one or more amino groups per molecule of the XTEN) and consistent with the single sulfhydryl group that exists on the payload. The reaction mixture is incubated at room temperature for 30 minutes or 2 hours at 4° C. Conjugation efficiency can be estimated by SDS-PAGE followed by protein staining or by appropriate analytical chromatography technique such as reverse phase HPLC or cation/anion exchange chromatography.

Figure 7:
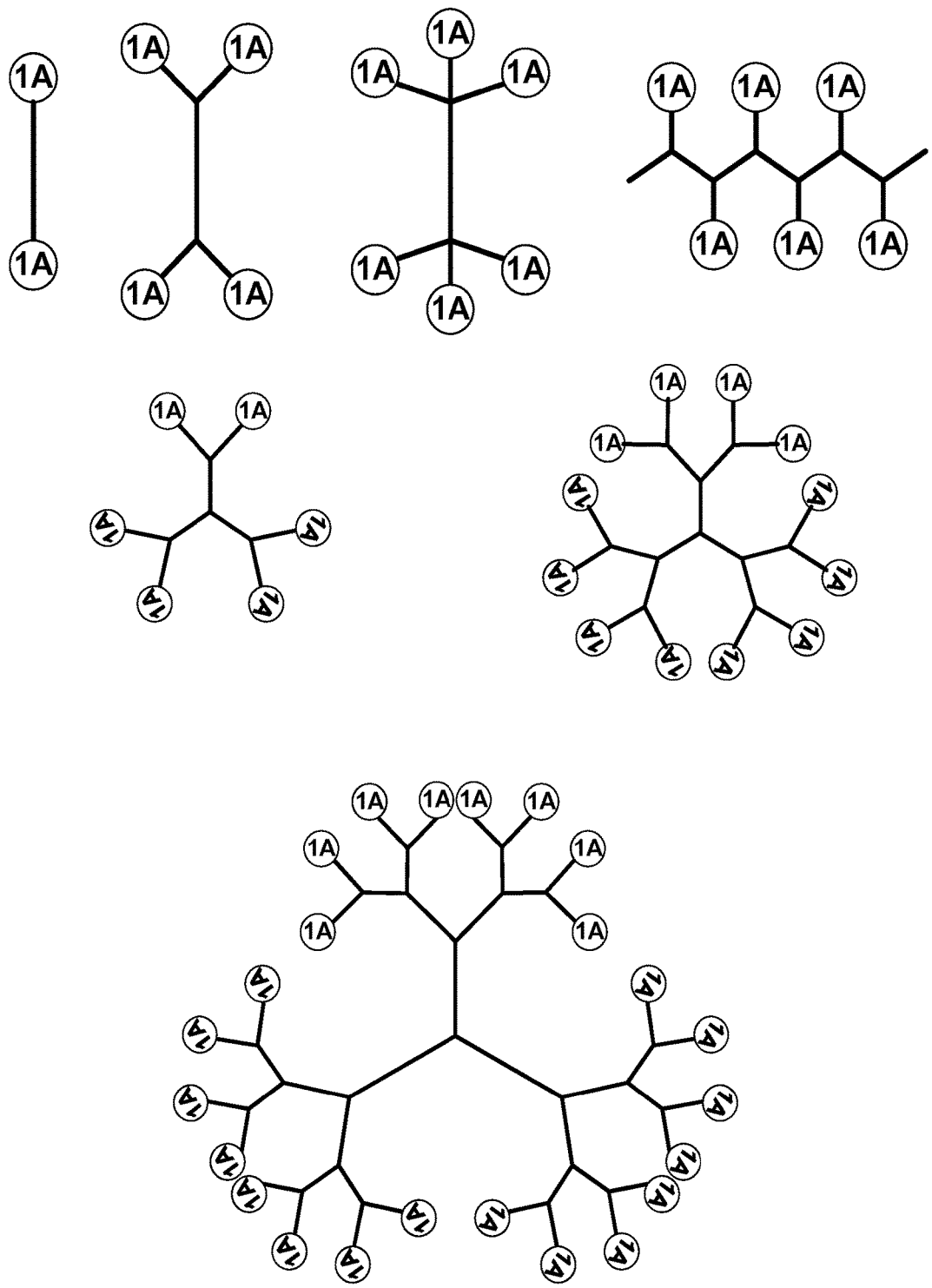
FIG. 7 shows different configurations of XTEN precursors that are multifunctional (or multivalent), including dedrimers. Non-limiting examples of trifunctional linkers are "Y-shaped" sulfhydryl-reactive TMEA (Tris-(2-Maleimidoethyl)amine) and amine-reactive TSAT (Tris-(succimimidyl aminotricetate). Any combination of reactive moieties can be designed using a scaffold polymer, either linear (forming a "comb" configuration) or branched (forming a "dendrimer" configuration), for multivalent display.
Figure 8:
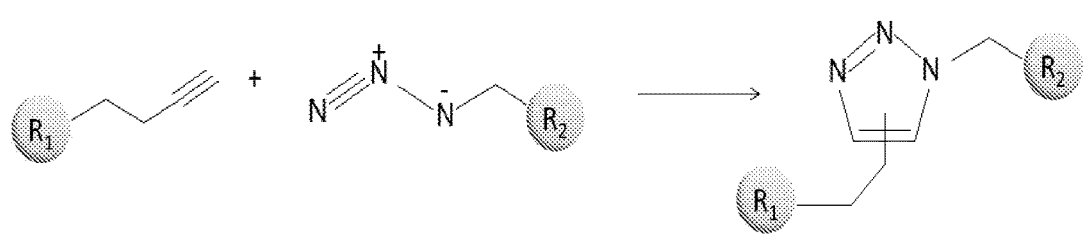
FIG. 8 shows a conjugation reaction utilizing the Huisgen 1,3-dipolar cycloaddition of alkynes to azides to form 1,4-disubstituted-1,2,3-triazoles, as shown.

In one embodiment, the invention provides XTEN-cross-linker conjugate compositions created using cross-linkers that are multivalent, resulting in compositions that have 2, 3, 4, 5, 6 or more XTEN. In another embodiment, the invention provides XTEN-cross-linker-payload conjugate compositions created using cross-linkers that are multivalent, resulting in compositions that have 2, 3, 4, 5, 6 or more XTEN linked to 1, 2, 3, 4, 5, 6 or more different payloads. Non-limiting examples of multivalent trifunctional cross-linkers are "Y-shaped" sulfhydryl-reactive TMEA (Tris-(2-Maleimidoethyl)amine) and amine-reactive TSAT (Tris-(succimimidyl aminotricetate). Any combination of reactive moieties can be designed using a scaffold polymer, either linear or branched, for multivalent compositions. Examples are shown in FIG. 7, wherein the constructs can have any combination of homo- or heterofunctional reactive groups. Of particular interest are trimeric configurations, shown schematically in FIGS. 21-23 and 97-105, and tetrameric configurations, shown in FIGS. 21 and 105-106. Not to be bound by a particular theory, a conjugate composition having three XTEN linked by a trifunctional linker (with payloads linked, in turn to XTEN via incorporated lysine or cysteine residues) can utilize proportionally shorter XTEN for each "arm" of the construct compared to a monovalent XTEN-payload composition wherein the same number of payloads are linked to the incorporated cysteine or lysine or N-terminal amino residues of each XTEN, and the resulting trimeric XTEN-payload composition will have a comparable apparent molecular weight and hydrodynamic radius as the monomeric XTEN-payload composition, yet will have lower viscosity, aiding administration of the composition to the subject through small-bore needles, and will provide equal or better potency from the payloads due to reduced steric hindrance and increased flexibility of the composition compared to the monomeric XTEN-payload composition having an equivalent number of XTEN amino acids.

In one embodiment, the invention provides a composition comprising three XTEN linked by a trivalent cross-linker wherein a solution containing approximately 100 mg/ml of protein of the composition has a viscosity that is at least about 5 cP, or about 6 cP, or about 7 cP, or about 8 cP, or about 9 cP, or about 10 cP lower than the corresponding linear XTEN of equal molecular weight and concentration. In another embodiment, the invention provides a composition comprising four XTEN linked by a tetravalent cross-linker wherein a solution containing approximately 100 mg/ml of protein of the composition has a viscosity that is at least about 5 cP, or about 6 cP, or about 7 cP, or about 8 cP, or about 9 cP, or about 10 cP lower than the corresponding linear XTEN of equal molecular weight and concentration.

Methods to make such compositions using the multivalent cross-linkers can employ similar reaction conditions as described herein, above, while an exemplary method and supporting data are provided in the Examples, below. Additionally, multivalent cross-linkers can be readily obtained by modification of lysine oligomers. For instance, the peptide Lys-Lys comprises three amino groups, one alpha-amino group and two epsilon amino groups at each Lys residue. These amino groups can be converted into many other reactive groups by reacting them with Bifunctional cross-linkers which have one amine-reactive group. For example the reaction of Lys-Lys with DBCO-NHS cross-linker yields a product that carries three DBCO groups. The reaction of Lys-Lys with NMal-NHS cross linker yields product that carries three NMal groups. In similar way one can obtain tetravalent cross-linkers based on Lys-Lys-Lys and higher valency cross-linkers by using longer lysine peptides.

Cross-linkers can be classified as either "homobifunctional" or "heterobifunctional" wherein homobifunctional cross-linkers have two or more identical reactive groups and are used in one-step reaction procedures to randomly link or polymerize molecules containing like functional groups, and heterobifunctional cross-linkers possess different reactive groups that allow for either single-step conjugation of molecules that have the respective target functional groups or allow for sequential (two-step) conjugations that minimize undesirable polymerization or self-conjugation. In a preferred embodiment, where XTEN-cross-linkers are prepared and isolated as compositions for subsequent reaction, the XTEN-cross-linker is linked to a heterobifunctional cross-linker and has at least one reactive group available for subsequent reaction.

In one embodiment, the invention provides XTEN-cross-linkers and XTEN-payloads that are conjugated utilizing cleavable cross-linkers with disulfide bonds. Typically, the cleavage is effected by disulfide bond reducing agents such as 3-mercaptoethanol, DTT, TCEP, however it is specifically contemplated that such compositions would be cleavable endogenously in a slow-release fashion by conditions with endogenous reducing agents (such as cysteine and glutathione). The following are non-limiting examples of such cross-linkers: APDP (N-(4-[p-Azidosalicylamido]butyl)-3'-(2'-pyridyldithio) propionamide), BASED (Bis (β-[4-azidosalicylamido]ethyl) disulfide), DPDPB (1,4-Di-(3'-[2'pyridyldithio]propionamido) butane), DSP (Dithiobis (succimidylpropionate) (Lomant's Reagent), DTBP (Dimethyl 3,3'-dithiobispropionimidate), DTME (Dithiobis-maleimidoethane), DTSSP (Sulfo-DSP) (3,3'-Dithiobis (sulfosuccinimidylpropionate)), LC-SPDP (Succinimidyl 6-(3'-[2-pyridyldithio]propionamido)hexanoate), PDPH (3-(2-Pyridyldithio)propionylhydrazide), SDAD (NHS-SS-Diazirine), SMPT (4-Succinimidyloxycarbonyl-methyl-α-

(2-pyridyldithio)toluene), SPDP (N-Succinimidyl 3-(2-pyridyldithio)propionate), Sulfo-LC-SMPT (Sulfosuccinimidyl 6-(α-methyl-α-[2-pyridyldithio]-toluamido)hexanoate), Sulfo-LC-SPDP (Sulfosuccinimidyl 6-(3'-[2-pyridyldithio]propionamido)hexanoate), Sulfo-SAED (Sulfosuccimidyl 2-[7-azido-4-methylcoumarin-3-acetamido]ethyl-1,3'-dithiopropionate), Sulfo-SAND (Sulfosuccinimidyl-2-(m-azido-o-nitrobenzamido)ethyl 1,3'-dithiopropionate), Sulfo-SDAD (Sulfo-NHS-SS-Diazirine), Sulfo-SFAD (Sulfosuccinimidyl(perfluoroazidobenzamido) ethyl 1,3'-dithiopropionate. In another embodiment, XTEN-payload conjugates comprising BSOCOES (Bis(2-[succinimidoxycarbonyloxy]ethyl)sulfone) can be cleaved under alkaline conditions. In another embodiment, XTEN-payload conjugates comprising DST (Disuccinimidyl tartarate) and BMDB (1,4 Bismaleimidyl-2,3-dihydroxybutane) can be cleaved by periodate oxidation. EGS (Ethylene glycol bis (succinimidylsuccinate)) and Sulfo-EGS (Ethylene glycol bis (sulfo-succinimidyl succinate)) are cleaved by hydroxylamine but would be expected to be cleaved endogenously such that the active payload would be released from the conjugate.

In general, the conjugation reagents described above assume that a cross-linker is reactive with the otherwise stable and inert groups such as amines, sulfhydryls and carboxyls. In other embodiments, the invention provides a different approach of conjugation based on separate modifications of the XTEN and payload with two functional groups which are stable and inactive toward biopolymers in general yet highly reactive toward each other. Several orthogonal reactions have been grouped under the concept of click chemistry, which provides XTEN-azide/alkyne reactants that have good stability properties and are therefor particularly suited as reagents for subsequent conjugation with payloads in a separate reaction (Kolb H. C., Finn M. G., Sharpless K. B. Click chemistry: diverse chemical function from a few good reactions. (2001) Angew. Chem. Int. Ed. Engl. 40(11), 2004-2021). Generally, click chemistry is used as a reaction concept which embraces reactions involving (1) alkyne-azide; (2) "ene"-thiol, and (3) aldehyde-hydrazide, and the invention contemplates use of all three. One example is the Huisgen 1,3-dipolar cycloaddition of alkynes to azides to form 1,4-disubsituted-1,2,3-triazoles, shown in FIG. 8. Azide and alkyne moieties can be introduced into peptide/protein or drug payloads or into XTEN by chemical modification of N-terminal α-amino groups, ε-amino groups of lysine, and sulfhydryl groups of cysteine. Table 15 provides non-limiting examples of click chemistry reactants contemplated for use in the making of the conjugate compositions, wherein one component of the intended conjugate (and XTEN or a payload) is reacted with a reactant 1 of the Table and the second component (a payload or an XTEN) is reacted with a azide reactant 2 of the Table. For example, one molecule is modified with an alkyne moiety using an amine-reactive alkyne, such as 3-propargyloxypropanoic acid, NHS ester, acetylene-PEG4-NHS ester, dibenzylcyclooctyne (DBCO)-NHS ester, DBCO-PEG4-NHS ester, cyclooctyne (COT)-PEG2-NHS ester, COT-PEG3-NHS ester, COT-PEG4-NHS ester, COT-PEG2-pentafluorophenyl (PFP) ester, COT-PEG3-PFP ester, COT-PEG4-PFP ester, BCOT-PEG2-NHS ester, BCOT-PEG3-NHS ester, BCOT-PEG4-NHS ester, BCOT-PEG2-PFP ester, BCOT-PEG3-PFP ester, BCOT-PEG4-PFP ester. Alternatively, the molecule is modified with a sulfhydryl-reactive alkyne such as acetylene-PEG4-Maleimide, DBCO-Maleimide, or DBCO-PEG4-Maleimide. The second molecule is modified with azide-PEG2-NHS ester, azide-PEG3-NHS ester, azide-PEG4-NHS ester, azide-PEG2-PFP ester, azide-PEG3-PFP ester, azide-PEG4-PFP ester or azide-PEG4-Maleimide. The azide and alkyne moieties can be used interchangeably; they are biologically unique, stable and inert towards biological molecules and aqueous environments. When mixed, the azide and alkyne reactants form an irreversible covalent bond without any side reactions (Moses J. E. and Moorhouse A. D. The growing applications of click chemistry. (2007) Chem. Soc. Rev. 36, 1249-1262; Breinbauer R. and Köhn M. Azide-alkyne coupling: a powerful reaction for bioconjugate chemistry. (2003) ChemBioChem 4(11), 1147-1149; Rostovtsev V. V., Green L. G., Fokin V. V., Sharpless K. B. A stepwise Huisgen cycloaddition process: copper(I)-catalyzed regioselective "ligation" of azides and terminal alkynes. (2002) Angew Chem Int Ed Engl. 41(14), 2596-2599). In one embodiment, the invention provides a conjugate comprising a first XTEN conjugated to a second XTEN wherein the first XTEN is linked to a alkyne reactant 1 from Table 15, the second XTEN is linked to a azide reactant 2 from Table 15, and then the first XTEN and the second XTEN are linked under conditions effective to react the alkyne reactant 1 and the azide reactant 2, resulting in the XTEN-XTEN conjugate. In another embodiment, the invention provides a conjugate comprising a first XTEN conjugated to a payload wherein the XTEN is linked to a alkyne reactant 1 from Table 15, the payload is linked to a azide reactant 2 from Table 15, and then the XTEN and the payload are linked under conditions effective to react the alkyne reactant 1 and the azide reactant 2, resulting in the XTEN-payload conjugate. In another embodiment, the invention provides a conjugate comprising a first XTEN conjugated to a payload wherein the XTEN is linked to a azide reactant 2 from Table 15, the payload is linked to a alkyne reactant 1 from Table 15, and then the XTEN and the payload are linked under conditions effective to react the alkyne reactant 1 and the azide reactant 2, resulting in the XTEN-payload conjugate. In the foregoing embodiments, the conditions to effect the reactions are those described herein or are reaction conditions known in the art for the conjugation of such reactants. The invention also contemplates the various combinations of the foregoing conjugates; e.g., an XTEN-XTEN conjugate in which the XTEN are linked by click chemistry reactants and in which one XTEN further comprises one or more molecules of a payload conjugated to the XTEN using click chemistry, an XTEN-XTEN conjugate in which the XTEN are linked by click chemistry reactants in which one XTEN further comprises one or more molecules of a first payload conjugated to the XTEN using click chemistry and the second XTEN further comprises one or more molecules of a second payload conjugated to the XTEN using click chemistry. Additional variations on these combinations will be readily apparent to those of ordinary skill in the art.

TABLE 15

Alkyne and Azide Click-chemistry Reactants

| | Attached to: |
|---|---|
| Alkyne Reactant 1 | |
| 3-propargyloxypropanoic acid, NHS ester* | Amine |
| acetylene-(oxyethyl)$_n$-NHS ester*, where n is 1-10 | Amine |
| dibenzylcyclooctyne (DBCO)-NHS ester* | Amine |
| DBCO-(oxyethyl)$_n$- NHS ester*, where n is 1-10 | Amine |
| cyclooctyne (COT)-NHS ester* | Amine |
| COT-(oxyethyl)$_n$- NHS ester*, where n is 1-10 | Amine |

TABLE 15-continued

Alkyne and Azide Click-chemistry Reactants

| | Attached to: |
|---|---|
| COT-(oxyethyl)$_n$-pentafluorophenyl (PFP) ester, where n is 1-10 | Amine |
| BCOT-NHS ester* | Amine |
| BCOT-(oxyethyl)$_n$- NHS ester*, where n is 1-10 | Amine |
| BCOT-(oxyethyl)$_n$-pentafluorophenyl (PFP) ester, where n is 1-10 | Amine |
| 6-(11,12-didehydrodibenzo[b,f]azocin-5(6H)-yl)-6-oxohexanoic acid N-hydroxysulfosuccinimide ester | Amine |
| ccetylene-(oxyethyl)$_n$-maleimide, where n is 1-10 | Thiol |
| DBCO-maleimide | Thiol |
| COT-maleimide | Thiol |
| BCOT-maleimide | Thiol |
| Azide Reactant 2 | |
| 3-azide-propionic acid, NHS ester* | Amine |
| 6-azide-hexanoic acid, NHS ester* | Amine |
| 3-azide-propionic acid, PFP ester | Amine |
| 6-azide-hexanoic acid, PFP ester | Amine |
| azide-(oxyethyl)$_n$NHS ester*, where n is 1-10 | Amine |
| azide-(oxyethyl)$_n$- PFP ester, where n is 1-10 | Amine |
| 1-azido-3,6,9,12-tetraoxapentadecan-15-oic acid N-hydroxysuccinimide ester | Amine |
| azide-(oxyethyl)$_n$- maleimide, where n is 1-10 | Thiol |

*could be either NHS ester or sulfo-NHS ester

Figure 9:
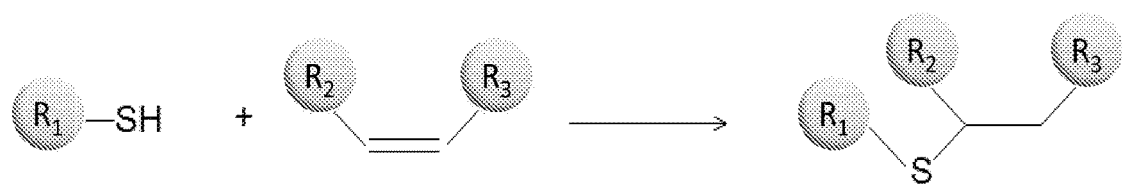
FIG. 9 shows a conjugation reaction using thio-ene based click chemistry that may proceed by free radical reaction, termed thiol-ene reaction, or anionic reaction, termed thiol Michael addition.

In some embodiments, the XTEN-XTEN conjugates and the XTEN-payload conjugates are conjugated using thio-ene based click chemistry that proceeds by free radical reaction, termed thiol-ene reaction, or anionic reaction, termed thiol Michael addition (see FIG. 9) (Hoyle C. E. and Bowman C. N. Thiol-ene click chemistry. (2010) *Angew. Chem. Int. Ed.* 49, 1540-1573). It particular, is believed that thiol Michael addition is better suited for XTEN-payload conjugates wherein the payload is a protein (Pounder R. J. et. al. Metal free thiol-maleimide 'Click' reaction as a mild functionalisation strategy for degradable polymers. (2008) *Chem Commun (Camb)*. 41, 5158-5160). As at least one molecule needs to contain a free thiol group, a cysteine-engineered XTEN can be utilized if the payload does not contain cysteine. Alternatively, the thiol group can be introduced by chemical modification of N-terminal α-amino group or the lysine ε-amino groups of either the XTEN or the payload peptide/protein using thiolating reagents such as 2-iminothiolane (Traut's reagent), SATA (N-succinimidyl S-acetylthioacetate), SATP (N-succinimidyl S-acetylthiopropionate), SAT-PEO$_4$-Ac (N-Succinimidyl S-acetyl(thiotetraethylene glycol)), SPDP (N-Succinimidyl 3-(2-pyridyldithio) propionate), LC-SPDP (Succinimidyl 6-(3'-[2-pyridyldithio] propionamido)hexanoate). Such methods are known in the art (Carlsson J. et al. (1978) *Biochem. J.* 173, 723-737; Wang D. et al. (1997) *Bioconjug. Chem.* 8, 878-884; Traut R. R. et al. (1973) *Biochemistry* 12(17), 3266-3273; Duncan, R. J. S. et al. (1983) *Anal. Biochem.* 132. 68-73; U.S. Pat. No. 5,708,146). The second component of thiol-Michael addition reaction requires a reagent with electron-deficient carbon-carbon double bond, such as in (meth)acrylates, maleimides, α,β-unsaturated ketones, fumarate esters, acrylonitrile, cinnamates, and crotonates. The N-maleimides are commonly used as sulfhydryl-reactive functionalities and can be introduced into the payload protein or the XTEN molecule via N-terminal α-amino group or Lys ε-amino group modification using commercially available heterobifunctional cross-linkers such as AMAS (N-(α-Maleimidoacetoxy)-succinimide ester), BMPS (N-(β-Maleimidopropyloxy)succinimide ester) and others described above. The resulting two molecules containing free thiol and maleimide moieties, respectively, form a stable covalent bond under mild conditions, resulting in a XTEN-payload linked by maleimide.

Figure 10:
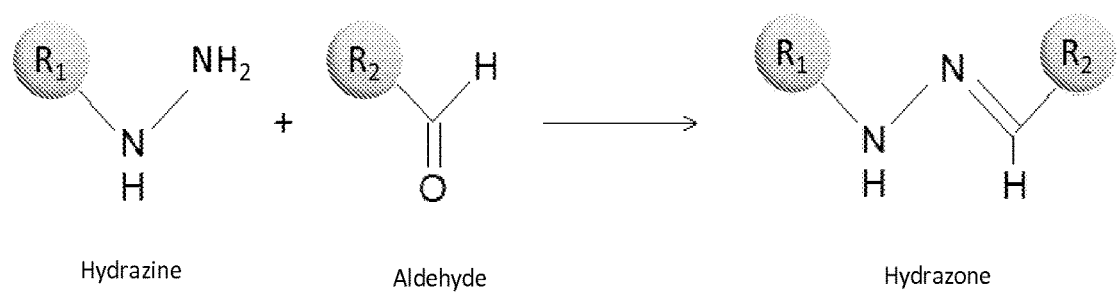
FIG. 10 shows a conjugation reaction utilizing click chemistry based on reactions between hydrazides and aldehydes, resulting in the illustrated hydrazone linkage in the XTEN-payload.

In other embodiments, XTEN-XTEN conjugates and XTEN-payload conjugates are created utilizing click chemistry based on reactions between hydrazides and aldehydes, such as described by Ganguly et al. and as shown in FIG. 10 (Ganguly T. et al. The hydrazide/hydrazone click reaction as a biomolecule labeling strategy for M(CO)3 (M=Re, 99mTc) radiopharmaceuticals. (2011) *Chem. Commun.* 47, 12846-12848). For example, an XTEN can be modified to have a hydrazine or hydrazide that is mixed with a payload having an aldehyde group to yield the desired XTEN-payload conjugate. In one embodiment, the invention provides XTEN with at least one hydrazine or hydrazide introduced in either the α-N-terminal amino group or, alternatively one or more lysine ε-amino groups are modified to provide an XTEN suitable as a reagent for conjugation to a target payload as it is considered to be stable. The resulting bis-arylhydrazones formed from aromatic hydrazines and aromatic aldehydes are stable to 92° C. and a wide range of pH values from 2.0-10.0 (Solulink, Inc., Protein-Protein Conjugation Kit, Technical Manual, Catalog # S-9010-1). The leaving group in the reaction is water and no reducing agents (e.g., sodium cyanoborohydride) are required to stabilize the bond. Molecules modified with either hydrazine/hydrazide or aldehyde moieties have good stability in aqueous environments and remain active without special handling requirements. The amino group(s) of the XTEN molecule are modified by NHS-ester/hydrazide, such as SANH (succinimidyl 4-hydrazinonicotinate acetone hydrazone), C6-SANH (C6-Succinimidyl 4-hydrazinonicotinate acetone hydrazone), SHTH (Succinimidyl 4-hydrazidoterephthalate hydrocholoride). In a typical reaction, a protein is prepared as 1-5 mg/ml solution in modification buffer (100 mM Phosphate, 150 mM NaCl, pH 7.4) and the modifying agent is added in a 5- to 20-fold molar excess and the reaction is carried out for 2 hrs at room temperature. Separately, the payload molecule is modified with NHS-ester/aldehyde SFB (succinimidyl 4-formylbenzoate) or C6-SFB (C6-Succinimidyl 4-formylbenzoate) under similar conditions. Both modified molecules are then desalted into conjugation buffer (100 mM phosphate, 150 mM NaCl, pH 6.0). The resulting components are mixed together using 1 mole equivalent of a limiting protein and 1.5-2 mole equivalents of a protein that can be used in abundance. A catalyst buffer of 100 mM aniline in 100 mM phosphate, 150 mM NaCl, pH 6.0 is added to adjust the final concentration of aniline to 10 mM and the reaction is carried out for 2 hrs at room temperature.

In another embodiment, the XTEN-payload conjugate can be produced by reaction between an aldehyde and primary amino group followed by reduction of the formed Schiff base with sodium borohydride or cyanoborohydride. As a first step in the method, an XTEN molecule, such as XTEN with a primary α-amino group or Lys-containing XTEN with an ε-amino group, is modified by NHS-ester/aldehyde SFB (succinimidyl 4-formylbenzoate), C6-SFB (C6-succinimidyl 4-formylbenzoate) or SFPA (succinimidyl 4-formylphenoxyacetate) using typical amine-NHS chemistry in an amine-free coupling buffer such as 0.1M sodium phosphate, 0.15M NaCl, pH 7.2. The resulting modified aldehyde-XTEN can either be held at this point as an XTEN-cross-linker composition or can be used as a reagent to create an XTEN-payload conjugate. To make the XTEN-payload, the modified aldehyde-XTEN is mixed with a payload with a reactive amino-group and a mild reducing agent such as 20-100 mM sodium cyanoborohydride. The reaction mixture is incubated up to 6 hours at room temperature or overnight at 4° C. Unreacted aldehyde groups are then blocked with 50-500 mM Tris.HCl, pH 7.4 and 20-100 mM sodium cyanoborohydride, permitting separation of the conjugated purified XTEN-payload.

Figure 11:
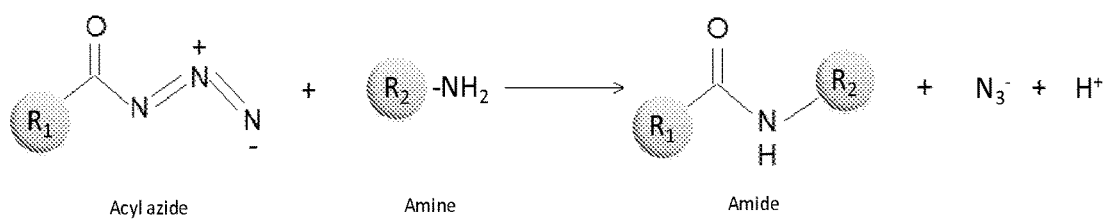
FIG. 11 shows a reaction between a C-terminal acylazide and a primary amino group resulting in the formation of an amide bond.

In other embodiments, the invention provides XTEN-payload conjugates comprising peptides or protein payloads wherein the payload is conjugated via chemical ligation based on the reactivity of the peptide/protein C-terminal acyl azide of the payload. As an example, when the peptide or protein is produced using solid-phase peptide synthesis (SPPS) with hydroxymethylbenzoic acid (HMBA) resin, the final peptide can be cleaved from the resin by a variety of nucleophilic reagents to give access to peptides with diverse C-terminal functionalities. In one embodiment, the method includes hydrazinolysis of the peptidyl/protein resins to yield peptide or protein hydrazides. Nitrosation of resulting acyl hydrazides with sodium nitrite or tert-butyl nitrite in dilute hydrochloric acid then results in formation of acyl azides. The resulting carbonyl azide (or acyl azide) is an activated carboxylate group (esters) that can react with a primary amine of an XTEN to form a stable amide bond, resulting in the XTEN-payload conjugate. In alternative embodiments, the primary amine could be the α-amine of the XTEN N-terminus or one or more ε-amine of engineered lysine residues in the XTEN sequence. In the conjugation reaction, the azide function is the leaving group, shown in FIG. 11. The conjugation reaction with the amine groups occurs by attack of the nucleophile at the electron-deficient carbonyl group (Meienhofer, J. (1979) The Peptides: Analysis, Synthesis, Biology. Vol. 1, Academic Press: N.Y.; ten Kortenaar P. B. W. et. al. Semisynthesis of horse heart cytochrome c analogues from two or three fragments. (1985) Proc. Natl. Acad. Sci. USA 82, 8279-8283)

Figure 12:
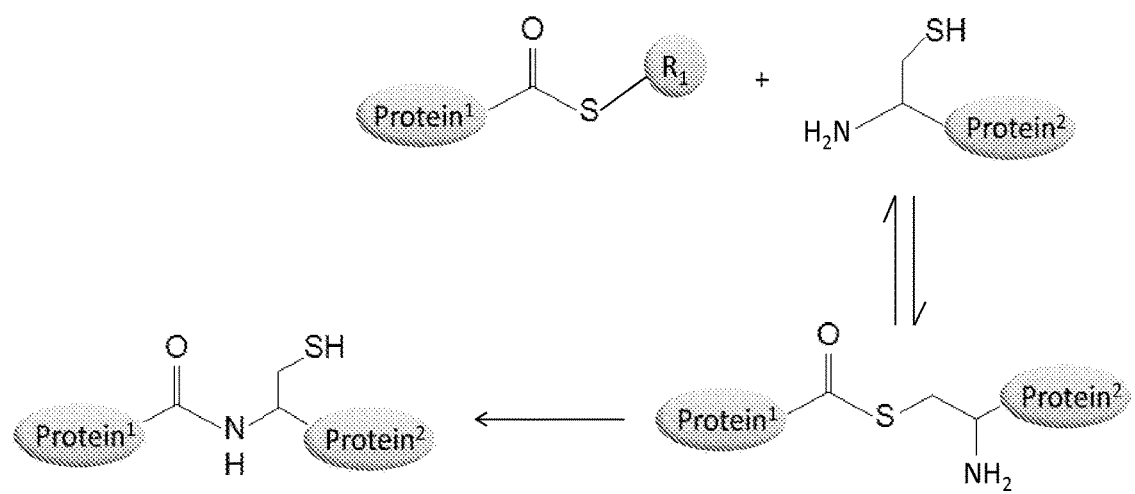
FIG. 12 shows a conjugation reaction utilizing Native Chemical Ligation (NCL) involving a C-terminal thioester as an electrophile and N-terminal Cysteine as a nucleophile. The result of this reaction is a native amide bond at the ligation site of the XTEN-payload composition.

In yet other embodiments, the invention provides XTEN-cross-linker and XTEN-payload conjugates in which the conjugation is performed by orthogonal protein ligation in which an initial chemoselective capture is followed by an intramolecular acyl rearrangement, as shown in FIG. 12. The chemoselective capture requires a nucleophile or electrophile proximally placed at an N-terminal amine and another compatible electrophile or nucleophile also proximally located at a C-terminal carboxylic ester. In the embodiment, it is specifically contemplated that the XTEN can serve as either Protein1 or Protein2 in FIG. 12. Thus, in alternative embodiments, the XTEN can be reacted with appropriate reagents to produce the thioester on the C-terminus or introduce a cysteine on the N-terminus to produce alternative XTEN-cross-linker compositions. In using the foregoing XTEN-cross-linker conjugates to make the XTEN-payload, the chemoselective capture of the nucleophile and electrophile pair forming an ester or a thioester brings the N-terminal amino group and C-terminal ester of the respective reactants into such a close proximity to permit a spontaneous intramolecular acyl transfer to form an amide bond. Most orthogonal ligation reactions do not require protection of side-chain groups and take place under mild conditions that are compatible with biological environments (Tam J. P., Xu J., Eom K. D. Methods and strategies of peptide ligation. (2001) Biopolymers (Peptide Science) 60, 194-205).

Figure 13:
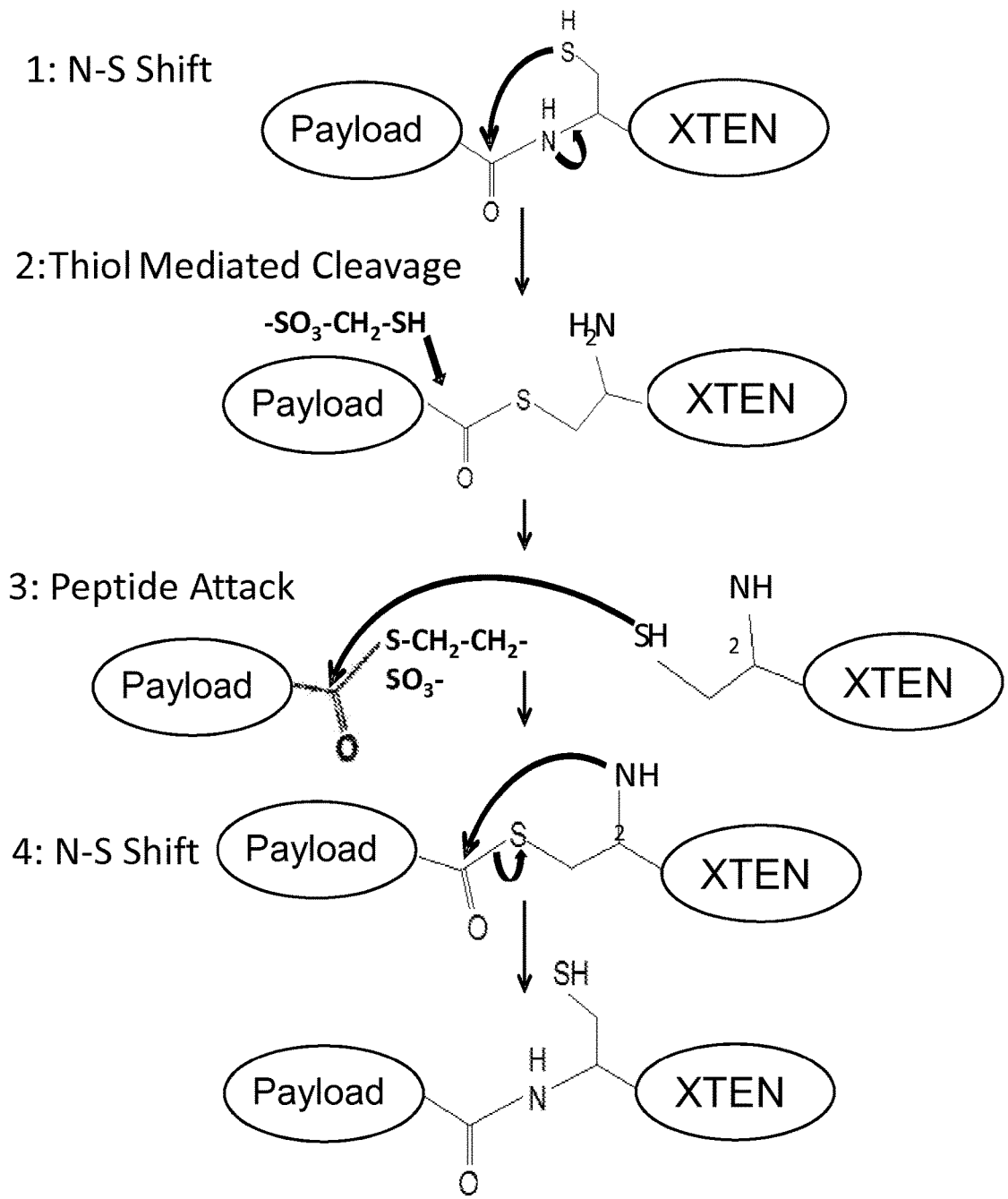
FIG. 13 shows a conjugation reaction utilizing expressed protein ligation (EPL) methodology. The EPL method is based on protein splicing, the process in which a protein undergoes an intramolecular rearrangement resulting in the extrusion of an internal sequence (intein) and the joining of the lateral sequences (exteins). In the method, the fused protein undergoes an N-S shift when the side chain of the first cysteine residue of the intein portion of the precursor protein nucleophilically attacks the peptide bond of the residue immediately upstream (that is, for example, the final residue of XTEN) to form a linear thioester intermediate, followed by a rearrangement to form to form an amide bond between the XTEN-cross-linker and the payload.

In another embodiment, the conjugates can be created by a method reaction known as Native Chemical Ligation (NCL) involving a C-terminal thioester as an electrophile and N-terminal cysteine as a nucleophile. The result of this reaction is a native amide bond at the ligation site of the XTEN-payload conjugate (Dawson P. E., Muir T. W., Clark-Lewis I., Kent S. B. Synthesis of proteins by native chemical ligation. (1994) Science 266, 776-779; Tam J. P.; Lu Y.-A.; Liu C. F.; Shao, J. Peptide synthesis using unprotected peptides through orthogonal coupling methods. (1995) Proc. Natl. Acad. Sci. USA, 92, 12485-12489; Johnson, E. C. B.; Kent, S. B. H. J. Insights into the mechanism and catalysis of the native chemical ligation reaction. (2006) J. Am. Chem. Soc. 128, 6640-6646; Kent S. B. (2009) Total chemical synthesis of proteins. (2009) Chem. Soc. Rev. 38:338-351). The first amino acid of the C-terminal component in NCL reaction (shown as Protein2 in FIG. 12) is cysteine. Such a protein can be XTEN with cysteine in the first position or any other protein prepared by conventional recombinant protein biosynthesis, including a peptide/protein payload. The N-terminal component (shown as Payload in FIG. 13) is prepared as C-terminal thioester by chemical synthesis. Examples of thioester synthesis methods are known and available in the art, such as those described, for example, in Li X., Kawakami T., Aimoto S., Direct preparation of peptide thioesters using an Fmoc solid-phase method. (1998) Tetrahedron Lett., 39, 8660-8672); Ingenito R., Bianchi E., Fattori D., Pessi A. Solid-phase synthesis of peptide C-terminal thioesters by Fmoc/tBu chemistry. (1999) J. Am. Chem. Soc., 121, 11369-11374); Sewing A., Hilvert D. Fmoc-compatible solid-phase peptide synthesis of long C-terminal peptide thioesters. (2001) Angew. Chem. Int. Ed. 40, 3395-3398; Brask J., Albericio F., Jensen K. J., Fmoc solid-phase synthesis of peptide thioesters by masking as trithioorthoesters. (2003) Org. Lett., 2003, 5, 2951-2953; Ollivier N., Behr J.-B., El-Mahdi O., Blanpain A., Melnyk O. Fmoc-solid-phase synthesis of peptide thioesters using an intramolecular N, S-acyl shift. (2005) Org. Lett., 7, 2647-2650. Usually, α-alkylthioesters are preferred because of ease of preparation and storage. However, because they are rather unreactive, the ligation reaction is catalyzed by in situ transthioesterification with thiol additives, with the most common thiol catalysts being 2-mercaptoethanesulfonate (MESNa) or 4-mercaptophenylacetic acid (MPAA). Chemical conjugation is typically complete in few hours and with high yields. While all 20 natural amino acids are suitable as the last residue of N-terminal component, the highest ligation rates were reported for glycine and histidine, making XTEN particularly suited for this reaction as the exemplary XTEN of Table 2 are nearly all glycine N-terminal polypeptides (Hackeng T. M. et al. Protein synthesis by native chemical ligation: expanded scope by using straightforward methodology. (1999) Proc. Natl. Acad. Sci. USA 96, 10068-10073). In other embodiments of this conjugation method, orthogonal ligation reactions include: (1)C-terminal thioacid with N-terminal BrAla or N-terminal aziridine (Tam J. P.; Lu Y.-A.; Liu C. F.; Shao, J. Peptide synthesis using unprotected peptides through orthogonal coupling methods. (1995) Proc. Natl. Acad. Sci. USA, 92, 12485-12489); (2)C-terminal thioacid with N-terminal Cys-perthioester (Liu, C. F., Rao, C., Tam, J. P. (1996) Tetrahedron Lett., 37, 933-936); (3)C-terminal thioester with N-terminal Homocysteine (Tam J. P., Yu Q. Methionine ligation strategy in the biomimetic synthesis of parathyroid hormones. (1998) Biopolymers 46(5), 319-327); and (4)C-terminal thioacid and N-terminal His (Zhang L., Tam J. P. (1997) Tetrahedron. Lett. 38, 3-6). In the method, the preparation of C-terminal thioesters by chemical synthesis constrains the size of N-terminal component in NCL reaction. However, use of expressed protein ligation (EPL) methodology overcomes size limitations of peptide α-thioester imposed by the need of chemical synthesis (Muir T. W.; Sondhi D.; Cole P. A. Expressed protein ligation: a general method for protein engineering. (1998) *Proc. Natl. Acad. Sci. USA* 95, 6705-6710; Muir T. W. Semisynthesis of proteins by expressed protein ligation. (2003) *Annu. Rev. Biochem.* 72, 249-289). The EPL method is based on protein splicing, the process in which a protein undergoes an intramolecular rearrangement resulting in the extrusion of an internal sequence (intein) and the joining of the lateral sequences (exteins). The latter process involves a formation of ester or thioester intermediates. In practicing the invention, the commercially available *Escherichia coli* protein expression vectors allows one to produce proteins of interest, such as XTEN, expressed in frame fused with an intein-chitin binding domain (CBD) sequence. In the method, the fused protein undergoes an N-S shift when the side chain of the first cysteine residue of the intein portion of the precursor protein nucleophilically attacks the peptide bond of the residue immediately upstream (that is, for example, the final residue of XTEN) to form a linear thioester intermediate, as shown in FIG. 13. The chemical ligation step is initiated by incubating the protein with thiophenol (or other thiol catalysts such as MESNa and MPAA) and a cysteine-containing synthetic peptide or protein. This results in the in situ generation of a highly reactive phenyl α-thioester derivative of, for example, the XTEN protein that then rapidly ligates with the synthetic peptide/protein payload to result in the desired XTEN-payload conjugate. In another embodiment, an XTEN-thioester intermediate can be cleaved by 50 mM 2-mercaptoethanesulfonic acid (MESNa) in 20 mM Na-HEPES, pH 8.5, 50-1000 mM NaC, and 1 mM EDTA (optional) and the resulting MESNa-tagged protein can be purified and stored −80° C. in 5 mM Bis Tris, pH 6.5, 250 mM NaCl until use as an XTEN-cross-linker conjugate for NCL reaction as the N-terminal component in the above described conjugation. The C-terminal component can be a payload with either a natural or synthetic peptide/protein with an N-terminal cysteine.

Figure 14:
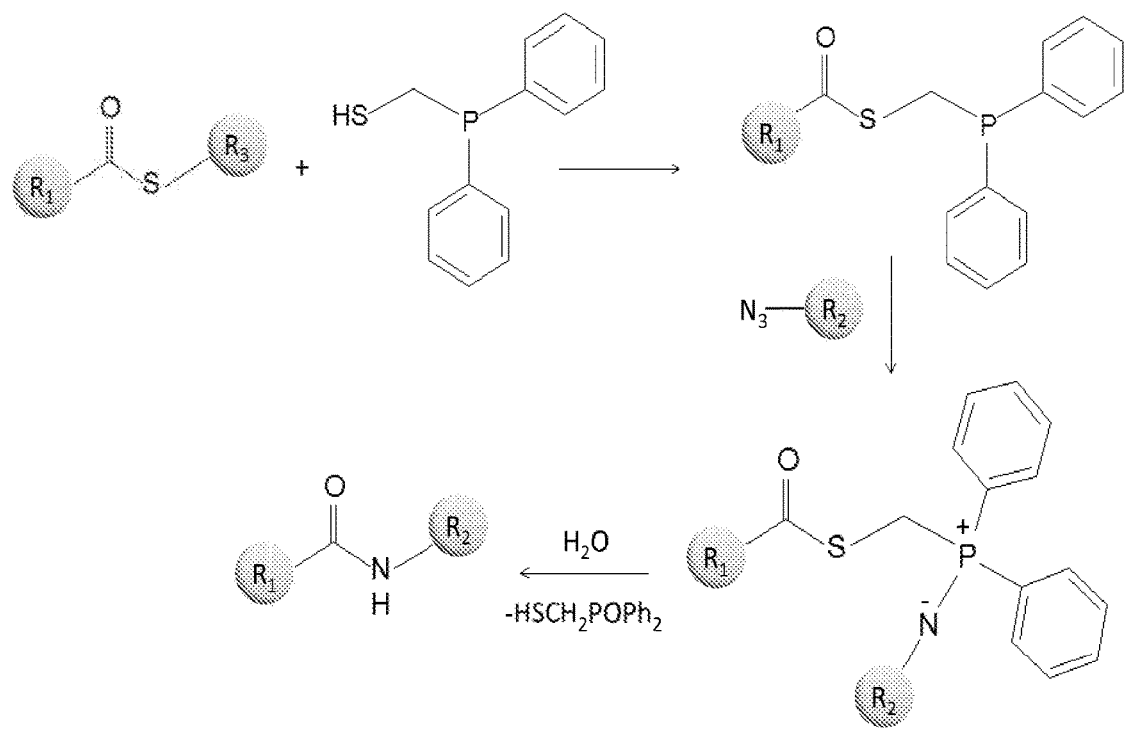
FIG. 14 shows a conjugation reaction utilizing traceless Staudinger ligation, like Native Chemical Ligation (NCL), resulting in a native amide bond at the ligation site.

In yet other embodiments, the invention provides XTEN-cross-linker and XTEN-payload conjugates in which the conjugation between the XTEN and payload is performed by traceless Staudinger ligation, like Native Chemical Ligation (NCL), resulting in a native amide bond at the ligation site. In an advantage to the method, a cysteine is not required at the ligation juncture (Saxon, E.; Armstrong, C. R.; Bertozzi, C. R. A "traceless" Staudinger ligation for the chemoselective synthesis of amide bonds. (2000) *Org. Lett.* 2, 21412143; Nilsson, B. L.; Kiessling, L. L.; Raines, R. T. Staudinger ligation: a peptide from a thioester and azide. (2000) *Org. Lett.* 2, 1939-1941). Instead, an N-terminal Protein 1 is prepared as a C-terminal thioester using diphenylphosphinemethanethiol (see FIG. 14), while a C-terminal Protein 2 is prepared as an N-terminal azide that can be generated via a diazo-transfer reaction (Cavender C. J.; Shiner V. J., Jr. (1972) *J. Org. Chem.* 22, 3567-3569; Lundquist J. T., IV, Pelletier J. C. Improved solid-phase peptide synthesis method utilizing alpha-azide-protected amino acids. (2001) *Org. Lett.* 3, 781-783). A phosphine residue reacts with the azide of Protein2 to form an iminophosphorane after elimination of nitrogen (Staudinger reaction). The resulting iminophosphorane with its highly nucleophilic nitrogen atom can also be regarded as an aza-ylide. The nucleophilic nitrogen atom of the aza-ylide then attacks the carbonyl group of Protein1, cleaving the thioester. It is specifically intended that either XTEN or the payload can be either Protein1 or Protein2 in this reaction. Hydrolysis of the rearranged XTEN-payload product finally produces a native amide and liberates phosphine component as phosphine(V) oxide. Bis(p-dimethylaminoethylphenyl) phosphinomethanethiol, a water-soluble variant of diphenylphosphinemethanethiol, mediates the rapid ligation of equimolar substrates in water (Tam, A.; Soellner, M. B.; Raines, R. T. Water-soluble phosphinothiols for traceless Staudinger ligation and integration with Expressed Protein Ligation. (2007) *J. Am. Chem. Soc.,* 129, 1142111-430).

Figure 15:
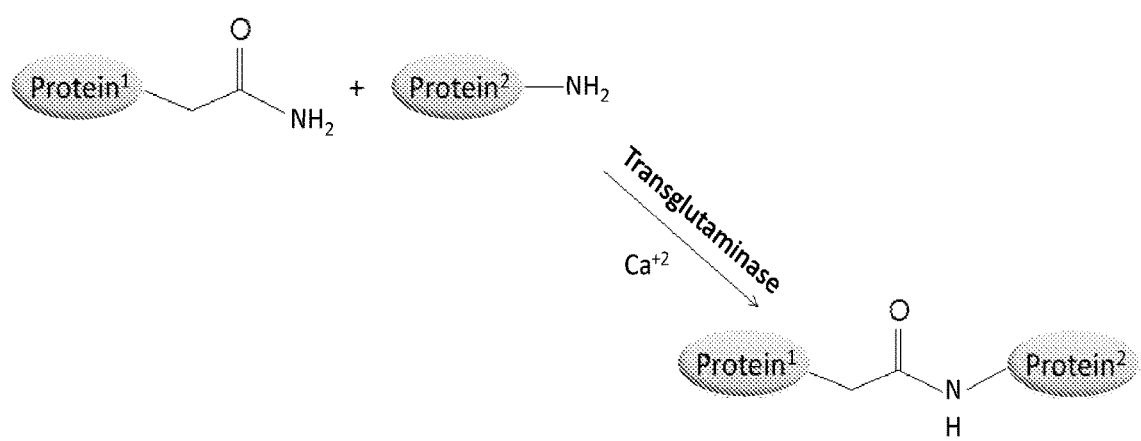
FIG. 15 shows a conjugation reaction utilizing enzymatic ligation. Transglutaminases are enzymes that catalyze the formation of an isopeptide bond between the γ-carboxamide group of glutamine of a payload peptide or protein and the ε-amino group of a lysine in a lysine-engineered XTEN (or an N-terminal amino group), thereby creating inter- or intramolecular cross-links between the XTEN and payload.

In another embodiment, the invention provides XTEN-payload conjugates prepared by enzymatic ligation. Transglutaminases are enzymes that catalyze the formation of an isopeptide bond between the γ-carboxamide group of glutamine of a payload peptide or protein and the ε-amino group of a lysine in a lysine-engineered XTEN, thereby creating inter- or intramolecular cross-links between the XTEN and payload (see FIG. 15), resulting in the composition (Lorand L, Conrad S. M. Transglutaminases. (1984) Mol. Cell Biochem. 58(1-2), 9-35). Non-limiting examples of enzymes that have been successfully used for ligations are factor XIIIa (Schense J. C., Hubbell J. A. Cross-linking exogenous bifunctional peptides into fibrin gels with factor XIIIa. (1999) *Bioconjug. Chem.* 10(1):75-81) and tissue transglutaminase (Collier J. H., Messersmith P. B. Enzymatic modification of self-assembled peptide structures with tissue transglutaminase. (2003) *Bioconjug. Chem.* 14(4), 748-755; Davis N. E., Karfeld-Sulzer L. S., Ding S., Barron A. E. Synthesis and characterization of a new class of cationic protein polymers for multivalent display and biomaterial applications. (2009) *Biomacromolecules* 10 (5), 1125-1134). The glutamine substrate sequence GQQQL (SEQ ID NO: 575) is known to have high specificity toward tissue transglutaminase (Hu B. H., Messersmith P. B. Rational design of transglutaminase substrate peptides for rapid enzymatic formation of hydrogels. (2003) *J. Am. Chem. Soc.* 125(47), 14298-14299). Tissue transglutaminase sequence specificity was less stringent for an acyl acceptor (lysine) than for acyl donor (glutamine) (Greenberg C. S., Birckbichler P. J., Rice R. H. Transglutaminases: multifunctional cross-linking enzymes that stabilize tissues. (1991) *FASEB J.* 1991, 5, 3071-3077).

Figure 16:
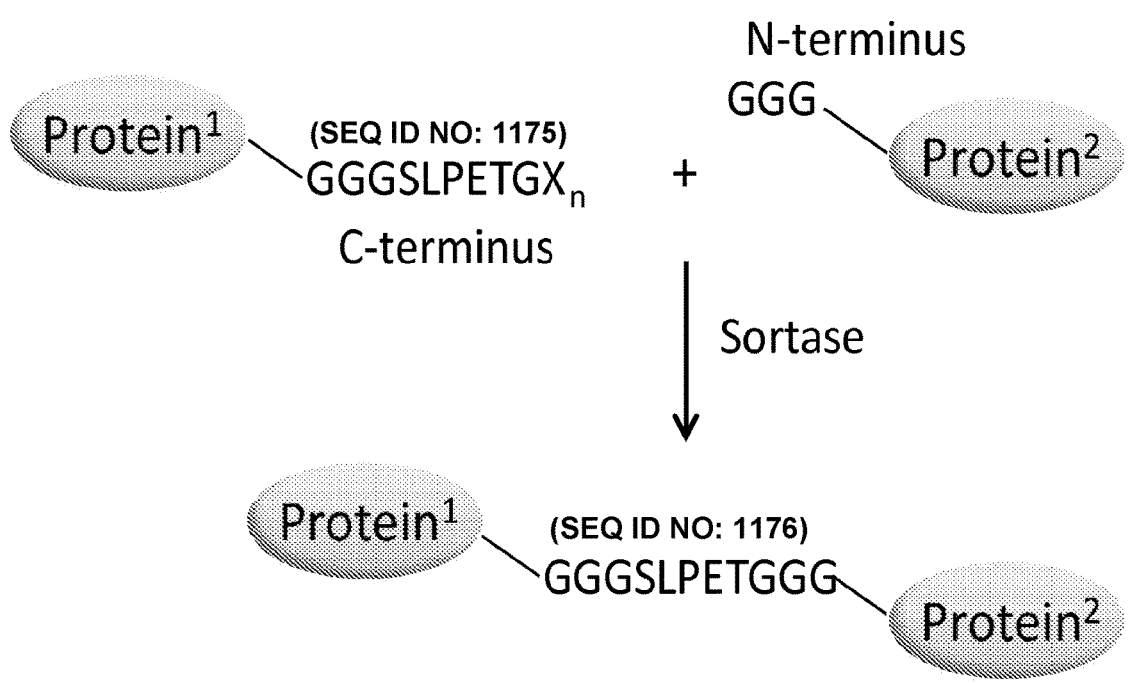
FIG. 16 shows enzymatically-created XTEN-payload compositions utilizing the sortase A transpeptidase enzyme from *Staphylococcus aureus* to catalyze the cleavage of a short 5-amino acid recognition sequence LPXTG (SEQ ID NO: 24) between the threonine and glycine residues of Protein1 that subsequently transfers the acyl-fragment to an N-terminal oligoglycine nucleophile of Protein1. By functionalizing the Protein2 to contain an oligoglycine, the enzymatic conjugation of the two proteins is accomplished in a site-specific fashion to result in the desired XTEN-payload composition.

In an alternative embodiment of an enzymatically-created XTEN-payload composition, the sortase A transpeptidase enzyme from *Staphylococcus aureus* is used to catalyze the cleavage of a short 5-amino acid recognition sequence LPXTG (SEQ ID NO: 24) between the threonine and glycine residues of Protein1, and subsequently transfers the acyl-fragment to an N-terminal oligoglycine nucleophile of Protein1 (see FIG. 16). By functionalizing the Protein2 to contain the oligoglycine, it is possible to enzymatically conjugate the two proteins in a site-specific fashion to result in the desired XTEN-payload composition. The (poly)peptide bearing the sortase recognition site (LPXTG) (SEQ ID NO: 24) can be readily made using standard molecular biology cloning protocols. It is convenient to introduce glutamic acid in the X position of the recognition site, as this residue is commonly found in natural substrates of sortase A (Boekhorst J., de Been M. W., Kleerebezem M., Siezen R. J. Genome-wide detection and analysis of cell wall-bound proteins with LPxTG-like sorting motifs. (2005) *J. Bacteriol.* 187, 4928-4934). A high level of transacylation can be achieved by placing the sortase cleavage site both at the C-terminus of the substrate (Popp M. W., Antos J. M., Grotenbreg G. M., Spooner E., Ploegh H. L. Sortagging: A versatile method for protein labeling. (2007) *Nat. Chem. Biol.* 311, 707-708) and in flexible loops (Popp M. W., Artavanis-Tsakonas K., Ploegh H. L. Substrate filtering by the active-site crossover loop in UCHL3 revealed by sortagging and gain-of-function mutations. (2009) *J. Biol. Chem.* 284(6), 3593-3602). For proteins labeled at the C-terminus, it is important that the glycine in the minimal LPETG (SEQ ID NO: 576) tag is not placed at the C-terminus; it must be in a peptide linkage with at least one further C-terminal amino acid. In addition, better linkage is achieved by adding an extra glycine to the C-terminus of the cleavage site to yield LPETGG (SEQ ID NO: 577) (Pritz S., Wolf Y., Kraetke O., Klose J., Bienert M., Beyermann M. Synthesis of biologically active peptide nucleic acid-peptide conjugates by sortase-mediated ligation. (2007) *J. Org. Chem.* 72, 3909-3912; Tanaka T., Yamamoto T., Tsukiji S., Nagamune T. Site-specific protein modification on living cells catalyzed by sortase. (2008) *Chembiochem* 95, 802-807). Nucleophiles compatible with sortase-mediated transpeptidation have the single structural requirement of a stretch of glycine residues with a free amino terminus. Successful transpeptidation can be achieved with nucleophiles containing anywhere from one to five glycines; however, in a preferred embodiment, a maximum reaction rate is obtained when two or three glycines are present.

While the various embodiments of conjugation chemistry have been described in terms of protein-protein conjugations, it is specifically intended that in practicing the invention, the payload moiety of the XTEN-payload conjugates can be a small molecule drug in those conjugation methods applicable to functional groups like amines, sulfhydryls, carboxyl that are present in the target small molecule drugs. It will be understood by one of ordinary skill in the art that one can apply even more broad chemical techniques compared to protein and peptides whose functionalities are usually limited to amino, sulfhydryl and carboxyl groups. Drug payloads can be conjugated to the XTEN through functional groups including, but not limited to, primary amino groups, aminoxy, hydrazide, hydroxyl, thiol, thiolate, succinate (SUC), succinimidyl succinate (SS), succinimidyl propionate (SPA), succinimidyl butanoate (SBA), succinimidyl carboxymethylate (SCM), benzotriazole carbonate (BTC), N-hydroxysuccinimide (NHS), p-nitrophenyl carbonate (NPC). Other suitable reactive functional groups of drug molecule payloads include acetal, aldehydes (e.g., acetaldehyde, propionaldehyde, and butyraldehyde), aldehyde hydrate, alkenyl, acrylate, methacrylate, acrylamide, active sulfone, acid halide, isocyanate, isothiocyanate, maleimide, vinylsulfone, dithiopyridine, vinylpyridine, iodoacetamide, epoxide, glyoxal, dione, mesylate, tosylate, and tresylate.

In another embodiment, the drug payloads can also be conjugated to XTEN-cross-linker conjugates using a heterocycle ring system in which one or more ring atoms is a heteroatom, e.g. a nitrogen, an oxygen, a phosphorus or a sulfur atom. The heterocycle group comprises at least 1 to as many as 20 carbon atoms and 1 to 3 heteroatoms selected from N, O, P, and S. In the embodiment, the heterocycle may be a monocycle having 3 to 7 ring members (2 to 6 carbon atoms and 1 to 3 heteroatoms selected from N, O, P, and S) or a bicycle having 7 to 10 ring members (4 to 9 carbon atoms and 1 to 3 heteroatoms selected from N, O, P, and S), for example: a bicyclo [4,5], [5,5], [5,6], or [6,6] system. Heterocycles are described in Paquette, Leo A. "Principles of Modern Heterocyclic Chemistry", W. A. Benjamin, New York, (1968); "The Chemistry of Heterocyclic Compounds, A series of Monographs" (John Wiley & Sons, New York, 1950 to present), in particular Volumes 13, 14, 16, 19, and 28. Non-limiting examples of heterocycles that may be found in drugs suitable for conjugation include pyridyl, dihydroypyridyl, tetrahydropyridyl (piperidyl), thiazolyl, tetrahydrothiophenyl, sulfur oxidized tetrahydrothiophenyl, pyrimidinyl, furanyl, thienyl, pyrrolyl, pyrazolyl, imidazolyl, tetrazolyl, benzofuranyl, thianaphthalenyl, indolyl, indolenyl, quinolinyl, isoquinolinyl, benzimidazolyl, piperidinyl, 4-piperidonyl, pyrrolidinyl, 2-pyrrolidonyl, pyrrolinyl, tetrahydrofuranyl, bis-tetrahydrofuranyl, tetrahydropyranyl, bis-tetrahydropyranyl, tetrahydroquinolinyl, tetrahydroisoquinolinyl, decahydroquinolinyl, octahydroisoquinolinyl, azocinyl, triazinyl, 6H-1,2,5-thiadiazinyl, 2H,6H-1,5,2-dithiazinyl, thienyl, thianthrenyl, pyranyl, isobenzofuranyl, chromenyl, xanthenyl, phenoxathinyl, 2H-pyrrolyl, isothiazolyl, isoxazolyl, pyrazinyl, pyridazinyl, indolizinyl, isoindolyl, 3H-indolyl, 1H-indazolyl, purinyl, 4H-quinolizinyl, phthalazinyl, naphthyridinyl, quinoxalinyl, quinazolinyl, cinnolinyl, pteridinyl, 4Ah-carbazolyl, carbazolyl, β-carbolinyl, phenanthridinyl, acridinyl, pyrimidinyl, phenanthrolinyl, phenazinyl, phenothiazinyl, furazanyl, phenoxazinyl, isochromanyl, chromanyl, imidazolidinyl, imidazolinyl, pyrazolidinyl, pyrazolinyl, piperazinyl, indolinyl, isoindolinyl, quinuclidinyl, morpholinyl, oxazolidinyl, benzotriazolyl, benzisoxazolyl, oxindolyl, benzoxazolinyl, and isatinoyl.

In some embodiments of the XTEN-payload conjugates with drugs as the payload, the drug molecules are attached to lysine- or cysteine engineered XTEN (such as the sequences of Table 3) by cross-linkers having two reactive sites for binding to the drug and the XTEN. Preferred cross-linker groups are those that are relatively stable to hydrolysis in the circulation, are biodegradable and are nontoxic when cleaved from the conjugate. In addition, the use of cross-linkers can provide the potential for conjugates with an even greater flexibility between the drug and the XTEN, or provide sufficient space between the drug and the XTEN such that the XTEN does not interfere with the binding between the pharmacophore and its binding site. In one embodiment, a cross-linker has a reactive site that has an electrophilic group that is reactive to a nucleophilic group present on an XTEN. Preferred nucleophiles include thiol, thiolate, and primary amine. The heteroatom of the nucleophilic group of a lysine- or cysteine-engineered XTEN is reactive to an electrophilic group on a cross-linker and forms a covalent bond to the cross-linker unit, resulting in an XTEN-cross-linker conjugate. Useful electrophilic groups for cross-linkers include, but are not limited to, maleimide and haloacetamide groups, and provide a convenient site for attachment to the XTEN. In another embodiment, a cross-linker has a reactive site that has a nucleophilic group that is reactive to an electrophilic group present on a drug such that a conjugation can occur between the XTEN-cross-linker and the payload drug, resulting in an XTEN-drug conjugate. Useful electrophilic groups on a drug include, but are not limited to, hydroxyl, thiol, aldehyde, alkene, alkane, azide and ketone carbonyl groups. The heteroatom of a nucleophilic group of a cross-linker can react with an electrophilic group on a drug and form a covalent bond. Useful nucleophilic groups on a cross-linker include, but are not limited to, hydrazide, oxime, amino, hydrazine, thiosemicarbazone, hydrazine carboxylate, and arylhydrazide. The electrophilic group on a drug provides a convenient site for attachment to a cross-linker.

In a particular embodiment, the conjugation of drugs to the lysine epsilon amino group of a subject lysine-engineered XTEN makes use of a reactive drug-N-hydroxylsuccinimide reactant, or esters such as drug-succinimidyl propionate, or drug-succinimidyl butanoate or other drug-succinimide conjugates. Alternatively, lysine residues of the subject lysine-engineered XTEN may be used to introduce free sulfhydryl groups through reaction with 2-iminothiolane. Alternatively, targeting substance lysines of subject lysine-engineered XTEN may be linked to a heterobifunctional reagent having a free hydrazide or aldehyde group available for conjugation with an active drug agent. Reactive esters can conjugate at physiological pH, but less reactive derivatives typically require higher pH values. Low temperatures may also be employed if a labile protein payload is being used. Under low temperature conditions, a longer reaction time may be used for the conjugation reaction.

In another particular embodiment, the invention provides XTEN-payload conjugates with an amino group conjugation with lysine residues of a subject lysine-engineered XTEN wherein the conjugation is facilitated by the difference between the pKa values of the α-amino group of the N-terminal amino acid (approximately 7.6 to 8.0) and pKa of the ε-amino group of lysine (approximately 10). Conjugation of the terminal amino group often employs reactive drug-aldehydes (such as drug-propionaldehyde or drug-butylaldehyde), which are more selective for amines and thus are less likely to react with, for example, the imidazole group of histidine. In addition, amino residues are reacted with succinic or other carboxylic acid anhydrides, or with N,N'-Disuccinimidyl carbonate (DSC), N,N'-carbonyl diimidazole (CDI), or p-nitrophenyl chloroformate to yield the activated succinimidyl carbonate, imidazole carbamate or p-nitrophenyl carbonate, respectively. Derivatization with these agents has the effect of reversing the charge of the lysinyl residues. Conjugation of a drug-aldehyde to the terminal amino group of a subject XTEN typically takes place in a suitable buffer performed at a pH which allows one to take advantage of the pKa differences between the ε-amino groups of the lysine residues and that of the α-amino group of the N-terminal residue of the protein. In the method of the embodiment, the reaction for coupling uses a pH in the range of from about pH 7 up to about 8. Useful methods for conjugation of the lysine epsilon amino group have been described in U.S. Pat. No. 4,904,584 and U.S. Pat. No. 6,048,720.

The person with ordinary skill in the art will be aware that the activation method and/or conjugation chemistry to be used in the creation of the XTEN-payload conjugates depends on the reactive groups of the XTEN polypeptide as well as the functional groups of the drug moiety (e.g., being amino, hydroxyl, carboxyl, aldehyde, sulfhydryl, alkene, alkane, azide, etc), the functional group of the drug-cross-linker reactant, or the functional group of the XTEN-cross-linker reactant. The drug conjugation may be directed towards conjugation to all available attachment groups on the engineered XTEN polypeptide such as the specific engineered attachment groups on the incorporated cysteine residues or lysine residues. In order to control the reactants such that the conjugation is directed to the appropriate reactive site, the invention contemplates the use of protective groups during the conjugation reaction. A "protecting group" is a moiety that prevents or blocks reaction of a particular chemically reactive functional group in a molecule under certain reaction conditions. The protecting group will vary depending upon the type of chemically reactive group being protected as well as the reaction conditions to be employed, as well as the presence of additional reactive groups in the molecule. Non-limiting examples of functional groups which may be protected include carboxylic acid groups, hydroxyl groups, amino groups, thiol groups, and carbonyl groups. Representative protecting groups for carboxylic acids and hydroxyls include esters (such as a p-methoxybenzyl ester), amides and hydrazides; for amino groups, carbamates (such as tert-butoxycarbonyl) and amides; for hydroxyl groups, ethers and esters; for thiol groups, thioethers and thioesters; for carbonyl groups, acetals and ketals; and the like. Such protecting groups are well-known to those skilled in the art and are described, for example, in T. W. Greene and G. M. Wuts, *Protecting Groups in Organic Synthesis*, Third Edition, Wiley, New York, 1999, and references cited therein. The conjugation may be achieved in one step or in a stepwise manner (e.g., as described in WO 99/55377), such as through addition of a reaction intermediate cross-linker, using the cross-linkers disclosed herein or those known in the art to be useful for conjugation to cysteine or lysine residues of polypeptides to be linked to reactive functional groups on drug molecules.

In some embodiments of the invention, the method for conjugating a cross-linker to a cysteine-engineered XTEN may provide that the XTEN is pre-treated with a reducing agent, such as dithiothreitol (DTT) to reduce any cysteine disulfide residues to form highly nucleophilic cysteine thiol groups (—CH$_2$SH). The reducing agent is subsequently removed by any conventional method, such as by desalting. The reduced XTEN thus reacts with drug-linker compounds, or cross-linker reagents, with electrophilic functional groups such as maleimide or α-halo carbonyl, according to, for example, the conjugation method of Klussman et al. (2004) *Bioconjugate Chemistry* 15(4), 765-773. Conjugation of a cross-linker or a drug to a cysteine residue typically takes place in a suitable buffer at pH 6-9 at temperatures varying from 4° C. to 25° C. for periods up to about 16 hours. Alternatively, the cysteine residues can be derivatized. Suitable derivatizing agents and methods are well known in the art. For example, cysteinyl residues most commonly are reacted with α-haloacetates (and corresponding amines), such as iodoacetic acid or iodoacetamide, to give carboxymethyl or carboxyamidomethyl derivatives. Cysteinyl residues also are derivatized by reaction with bromotrifluoroacetone, α-bromo-β-(4-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

In some instances, the conjugation is performed under conditions aiming at reacting as many of the available XTEN attachment groups as possible with drug or drug-linker molecules. This is achieved by means of a suitable molar excess of the drug in relation to the polypeptide. Typical molar ratios of activated drug or drug-linker molecules to polypeptide are up to about 1000-1, such as up to about 200-1 or up to about 100-1. In some cases, the ratio may be somewhat lower, however, such as up to about 50-1, 10-1 or 5-1. Equimolar ratios also may be used.

In the embodiments, the XTEN-payload conjugates of the disclosure retain at least a portion of the pharmacologic activity compared to the corresponding payload not linked to XTEN. In one embodiment, the XTEN-payload retains at least about 1%, or at least about 5%, or at least about 10%, or at least about 20%, or at least about 30%, or at least about 40%, or at least about 50%, or at least about 60%, or at least about 70%, or at least about 80%, or at least about 90%, or at least about 95% of the pharmacologic activity of the payload not linked to XTEN.

In one embodiment, XTEN-payload conjugates can be designed to release the payload in the body by unspecific or enzymatic hydrolysis of the linker, including disulfide bond reduction, pH-dependent release, or by exogenous or endogenous proteases, including the proteases of Table 9. Macromolecules can be taken up by the cell either through receptor-mediated endocytosis, adsorptive endocytosis or fluid phase endocytosis (Jain R. K. Transport of molecules across tumor vasculature. (1987) *Cancer Metastasis Rev.* 6(4), 559-593; Jain R. K. Transport of molecules, particles, and cells in solid tumors. (1999) *Ann. Rev. Biomed. Eng.* 1, 241-263; Mukherjee S., Ghosh R. N., Maxfield F. R. Endocytosis. (1997) *Physiol. Rev.* 77(3), 759-803). Upon cellular uptake of XTEN-payload, the payload can be released by low pH values in endosomes (pH 5.0-6.5) and lysosomes (pH 4.5-5.0), as well as by lysosomal enzymes (e.g., esterases and proteases). Example of acid-sensitive cross-linker is 6-maleimidodocaproyl hydrazone which can be coupled to thiol-bearing carriers. The hydrazone linker is rapidly cleaved at pH values <5 allowing a release of the payload in the acidic pH of endosomes and lysosomes following internalization of the conjugate (Trail P. A. et al. Effect of linker variation on the stability, potency, and efficacy of carcinoma-reactive BR64-doxorubicin immunoconjugates. (1997) *Cancer Res.* 57(1), 100-105; Kratz F. et al. Acute and repeat-dose toxicity studies of the (6-maleimidocaproyl)hydrazone derivative of doxorubicin (DOXO-EMCH), an albumin-binding prodrug of the anticancer agent doxorubicin. (2007) *Hum. Exp. Toxicol.* 26(1), 19-35). Clinically approved mAb-drug conjugate, gemtuzumab ozogamicin (Mylotarg™) is a drug-antibody conjugate containing a humanized mAb P67.6 against CD33, linked chemically to the cytotoxic antibiotic agent calicheamicin. The linker between the antibody and the drug incorporates two labile bonds: a hydrazone and a sterically hindered disulfide. It has been shown that the acid-sensitive hydrazone bond is the actual cleavage site (Jaracz S., Chen J., Kuznetsova L. V., Ojima I. Recent advances in tumor-targeting anticancer drug conjugates. (2005) *Bioorg. Med. Chem.* 13(17), 5043-5054).

For those XTEN-payload conjugates in which the payload is linked by a disulfide bond, the payload can be released from XTEN by reduction of disulfide bond within the labile linker. For example, huN901-DM1 is a tumor-activated immunotherapeutic prodrug developed by ImmunoGen, Inc. for the treatment of small cell lung cancer. The prodrug consists of humanized anti-CD56 mAb (huN901) conjugated with microtubule inhibitor maytansinoid DM1. An average of 3.5-3.9 molecules of DM1 are bound to each antibody via hindered disulfide bonds. Although the disulfide link is stable in blood, it is cleaved rapidly on entering the cell targeted by huM901, thus releasing active DM1 (Smith S. V. Technology evaluation: huN901-DM1, ImmunoGen. (2005) *Curr. Opin. Mol. Ther.* 7(4), 394-401). DM1 has been also coupled to Millennium Pharmaceuticals MLN-591, an anti-prostate-specific membrane antigen mAb. DM1 is linked to the antibody via a hindered disulfide bond that provides serum stability at the same time as allowing intracellular drug release on internalization (Henry M. D. et al. A prostate-specific membrane antigen-targeted monoclonal antibody-chemotherapeutic conjugate designed for the treatment of prostate cancer. (2004) *Cancer Res.* 64(21), 7995-8001).

Release of the payload from the carrier XTEN can be achieved by creating compositions using short cleavable peptides as linkers between the payload and XTEN. Example of the conjugate assessed clinically is doxorubicin-HPMA (N-(2-hydroxypropyl)methacrylamide) conjugate in which doxorubicin is linked through its amino sugar to the HPMA copolymer via a tetrapeptide spacer GlyPheLeuGly (SEQ ID NO: 578) that is cleaved by lysosomal proteases, such as cathepsin B (Vasey P. A. et al. Phase I clinical and pharmacokinetic study of PK1 [N-(2-hydroxypropyl)methacrylamide copolymer doxorubicin]: first member of a new class of chemotherapeutic agents-drug-polymer conjugates. (1999) *Clin. Cancer Res.* 5(1), 83-94). Other examples of carrier-drug conjugates with peptide linkers that reached clinical stage of development are macromolecular platinum complexes. Two HPMA-based drug candidates consisted of a HPMA copolymer backbone to which the complexing aminomalonate platinum complexes were bound through cathepsin B-cleavable peptide spacer GlyPheLeuGly (SEQ ID NO: 578) or tripeptide spacer GlyGlyGly (Rademaker-Lakhai J. M. et al. A Phase I and pharmacological study of the platinum polymer AP5280 given as an intravenous infusion once every 3 weeks in patients with solid tumors. (2004) *Clin. Cancer Res.* 10(10), 3386-3395; Sood P. et al. Synthesis and characterization of AP5346, a novel polymer-linked diaminocyclohexyl platinum chemotherapeutic agent. (2006) *Bioconjugate Chem.* 17(5), 1270-1279).

A highly selective method was developed to target prostate cancer via prostate-specific antigen (PSA) protease which is almost exclusively expressed in prostate tissue and prostate carcinomas. A novel albumin-binding prodrug of paclitaxel, EMC-ArgSerSerTyrTyrSerLeu-PABC-paclitaxel (SEQ ID NO: 579) (EMC: ε-maleimidocaproyl; PABC: p-aminobenzyloxycarbonyl) was synthesized. This prodrug was water soluble and was bound to endogenous and exogenous albumin. Albumin-bound form of the prodrug was cleaved by PSA releasing the paclitaxel-dipeptide Ser-Leu-PABC-paclitaxel. Due to the incorporation of a PABC self-eliminating linker, this dipeptide was rapidly degraded to liberate paclitaxel as a final cleavage product (Elsadek B. et al. Development of a novel prodrug of paclitaxel that is cleaved by prostate-specific antigen: an in vitro and in vivo evaluation study. (2010) *Eur. J. Cancer* 46(18), 3434-3444).

Self-immolative spacers have gained significant interest due to their utility in prodrug delivery systems. Several reports described linear self-eliminating systems or dendrimeric structures which can release all of their units through a domino-like chain fragmentation, initiated by a single cleavage event (Haba K. et al. Single-triggered trimeric prodrugs. (2005) *Angew. Chem., Int. Ed.* 44, 716-720; Shabat D. Self-immolative dendrimers as novel drug delivery platforms. (2006) *J. Polym. Sci., Part A: Polym. Chem.* 44, 1569-1578. Warnecke A., Kratz F. 2,4-Bis(hydroxymethyl) aniline as a building block for oligomers with self-eliminating and multiple release properties. (2008) *J. Org. Chem.* 73, 1546-1552; Sagi A. et al. Self-immolative polymers. (2008) *J. Am. Chem. Soc.* 130, 5434-5435). In one study, a self-immolative dendritic prodrug with four molecules of the anticancer agent camptothecin and two molecules of PEG5000 was designed and synthesized. The prodrug was effectively activated by penicillin-G-amidase under physiological conditions and free camptothecin was released to the reaction media to cause cell-growth inhibition (Gopin A. et al. Enzymatic activation of second-generation dendritic prodrugs: conjugation of self-immolative dendrimers with poly(ethylene glycol) via click chemistry. (2006) *Bioconjugate Chem.* 17, 1432-1440). Incorporation of a specific enzymatic substrate, cleaved by a protease that is overexpressed in tumor cells, could generate highly efficient cancer-cell-specific dendritic prodrug activation systems. Non-limiting examples of spacer sequences that are cleavable by proteases are listed in Table 9.

In some embodiments, the invention provides XTEN-payload configurations, including dimeric, trimeric, tetrameric and higher order conjugates in which the payload is attached to the XTEN using a labile linker as described herein, above. In one embodiment of the foregoing, the composition further includes a targeting component to deliver the composition to a ligand or receptor on a targeted cell. In another embodiment, the invention provides conjugates in which one, two, three, or four XTEN-payload compositions are conjugated with labile linkers to antibodies or antibody fragments, providing soluble compositions for use in targeted therapy of clinical indications such as, but not limited to, various treatment of tumors and other cancers wherein the antibody provides the targeting component and then, when internalized within the target cell, the labile linker permits the XTEN-payload to disassociate from the composition and effect the intended activity (e.g., cytotoxicity in a tumor cell). Hence, the inventive compositions are a type of immunoconjugate.

The unstructured characteristics and uniform composition and charge of XTEN result in properties that can be exploited for purification of XTEN-payload conjugates following a conjugation reaction. Of particular utility is the capture of XTEN conjugates by ion exchange, which allows the removal of un-reacted payload and payload derivatives. Of particular utility is the capture of conjugates by hydrophobic interaction chromatography (HIC). Due to their hydrophilic nature, most XTEN polypeptides show low binding to HIC resins, which facilitates the capture of XTEN-payload conjugates due to hydrophobic interactions between the payload and the column material, and their separation from un-conjugated XTEN that failed to conjugate to the payload during the conjugation process. The high purity of XTEN and XTEN-payload conjugates offers a significant benefit compared to most chemical or natural polymers, particularly pegylated payloads. Most chemical and natural polymers are produced by random- or semi-random polymerization, which results in the generation of many homologs. Such polymers can be fractionated by various methods to increase fraction of the target entity in the product. However, even after enrichment most preparations of natural polymers and their payload conjugates contain less than 10% target entity. Examples of PEG conjugates with G-CSF have been described in [Bagal, D., et al. (2008) Anal Chem, 80: 2408-18]. This publication shows that even a PEG conjugate that is approved for therapeutic use contains more than 100 homologs that occur with a concentration of at least 10% of the target entity.

The complexity of random polymers, such as PEG, is a significant impediment for the monitoring and quality control during conjugation and purification. In contrast, XTEN purified by the methods described herein have high levels of purity and uniformity. In addition, the conjugates created as described herein routinely contain greater than about 80%, 90%, 91%, 92%, 93%, 94%, 95%, 96%, 97%, 98%, or 99% of the intended target and in the intended configuration, resulting in easy to interpret mass spectra and chromatograms.

2. Monomeric XTEN-Cross-Linker, and XTEN-Payload Configurations

In another aspect, the invention provides XTEN-cross-linker conjugates and XTEN-payload conjugates with a single XTEN, wherein the conjugate is designed in different configurations. Exemplary configurations of such conjugates follow.

In one embodiment, the invention provides a conjugate having the configuration of formula IV:

IV wherein independently for each occurrence CL1 is a cross-linker; x is an integer from 1 to about 100, or 1 to about 50, or 1 to about 40, or 1 to about 20, or 1 to about 10, or 1 to about 5, or is 9, or is 3, or is 2, or is 1; and XTEN is a sequence having at least about 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3. In one embodiment of the conjugate of formula IV, CL1 is a cross-linker selected from Table 13. In another embodiment of the conjugate of formula IV, x has the foregoing ranges and a cross-linker of Table 13 is linked to each cysteine sulfur of the XTEN. In another embodiment of the conjugate of formula IV, x has the foregoing ranges and a cross-linker is linked to a each lysine epsilon amino group of the XTEN. In another embodiment of the conjugate of formula IV, x is 1 and a cross-linker of Table 13 is linked to the N-terminal amino group of the XTEN. It will be understood by one of skill in the art that the compositions of the foregoing embodiments comprising the cross-linker conjugated to an XTEN using the specified components represents the reaction product of the individual reactants and thus differs from the precise composition of the reactants. In another embodiment, the invention provides a preparation of the conjugate of formula IV in which at least about 80%, or at least about 90%, or at least about 91%, or at least about 92%, or at least about 93%, or at least about 94%, or at least about 95% of the XTEN molecules of the preparation of the conjugate have identical sequence length.

In another embodiment, the invention provides a conjugate having the configuration of formula V:

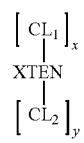

V wherein independently for each occurrence CL$_1$ is a cross-linker; x is an integer from 1 to about 100, or 1 to about 50, or 1 to about 40, or 1 to about 20, or 1 to about 10, or 1 to about 5, or is 9, or is 3, or is 2, or is 1; CL$_2$ is a cross-linker that is different from CL$_1$; y is an integer from 1 to about 100, or 1 to about 50, or 1 to about 40, or 1 to about 20, or 1 to about 10, or 1 to about 5, or is 9, or is 3, or is 2, or is 1, with the proviso that x+y is ≥2; and XTEN is a sequence having at least about 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3. In one embodiment of the conjugate of formula V, CL$_1$ and CL$_2$ are each selected from the group of cross-linkers set forth in Table 13. In one embodiment of the conjugate of formula V, x has the foregoing ranges and each CL$_1$ is linked to an epsilon amino group of each lysine of the XTEN and y has the foregoing ranges and each CL$_2$ is linked to a sulfur group of each cysteine of the XTEN. In another embodiment of the conjugate of formula V, x is 1 and CL$_1$ is linked to the N-terminal amino group of the XTEN and each CL$_2$ is linked to a cysteine sulfur group of the XTEN. It will be understood by one of skill in the art that the compositions of the foregoing embodiments comprising the cross-linker conjugated to an XTEN using the specified components represents the reaction product of the reactants and thus differs from the precise composition of the reactants. In another embodiment, the invention provides a preparation of the conjugate of formula V in which at least about 80%, or at least about 90%, or at least about 91%, or at least about 92%, or at least about 93%, or at least about 94%, or at least about 95% of the XTEN molecules of the preparation of the conjugate have identical sequence length.

In another aspect, the invention provides XTEN-payload conjugates having defined configurations. The invention takes advantage of the reactive XTEN-cross-linker conjugation partner compositions described herein to which reactive molecules of payloads can be joined by chemical reaction.

In one embodiment, the invention provides a conjugate having the configuration of formula VI:

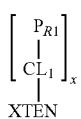

VI wherein independently for each occurrence $P_{R1}$ is a single atom residue of a payload, wherein the residue is selected from the group consisting of carbon, nitrogen, oxygen and sulfur, $CL_1$ is a cross-linker, x is an integer from 1 to about 100, or 1 to about 50, or 1 to about 40, or 1 to about 20, or 1 to about 10, or 1 to about 5, or is 3, or is 2, or is 1; and XTEN is a sequence having at least about 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3. In one embodiment of the conjugate of formula VI, the single atom residue of a payload is from a payload selected from the group consisting of the payloads set forth in Tables 11, 12, 18, 19, and 21. In one embodiment of the conjugate of formula VI, $CL_1$ is a cross-linker selected from Table 13. In one embodiment of the conjugate of formula VI, each cross-linker is linked to a cysteine sulfur of the XTEN. In another embodiment of the conjugate of formula VI, each cross-linker is linked to an lysine epsilon amino group of the XTEN. In another embodiment of the conjugate of formula VI, x is 1 and the cross-linker is linked to the N-terminal amino group of the XTEN. In another embodiment of the conjugate of formula VI, $CL_1$ is the reaction product of a first and a second click chemistry reactant selected from Table 15. In another embodiment, the invention provides a preparation of the conjugate of formula VI in which at least about 80%, or at least about 90%, or at least about 91%, or at least about 92%, or at least about 93%, or at least about 94%, or at least about 95% of the XTEN molecules of the preparation of the conjugate have identical sequence length.

In another embodiment, the invention provides a conjugate having the configuration of formula VII:

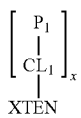

VII wherein independently for each occurrence: $P_1$ is a payload selected from the group consisting of the payloads set forth in Tables 11, 12, 18, 19, and 21; $CL_1$ is a cross-linker; x is an integer from 1 to about 100, or 1 to about 50, or 1 to about 40, or 1 to about 20, or 1 to about 10, or 1 to about 5, or is 9, or is 3, or is 2, or is 1; and XTEN is a sequence having at least about 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3. In one embodiment of the conjugate of formula VII, $CL_1$ is a cross-linker selected from Table 13. In one embodiment of the conjugate of formula VII, each cross-linker is linked to a cysteine sulfur of the XTEN. In another embodiment of the conjugate of formula VII, each cross-linker is linked to an lysine epsilon amino group of the XTEN. In another embodiment of the conjugate of formula VII, x is 1 and the cross-linker is linked to the N-terminal amino group of the XTEN. In one embodiment, the conjugate of formula VII is selected from the group consisting of the conjugates set forth in Table 21. In another embodiment of the conjugate of formula VII, $CL_1$ is the reaction product of a first and a second click chemistry reactant selected from Table 15. It will be understood by one of skill in the art that the compositions of the foregoing embodiments comprising the payload conjugated to an XTEN-cross-linker using the specified components represents the reaction product of the reactants and thus differs from the precise composition of the reactants. In another embodiment, the invention provides a preparation of the conjugate of formula VII in which at least about 80%, or at least about 90%, or at least about 91%, or at least about 92%, or at least about 93%, or at least about 94%, or at least about 95% of the XTEN molecules of the preparation of the conjugate have identical sequence length.

In another embodiment, the invention provides a conjugate having the configuration of formula VIII:

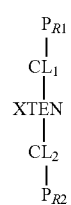

VIII wherein independently for each occurrence $P_{R1}$ is a single atom residue of a payload, wherein the residue is selected from the group consisting of carbon, nitrogen, oxygen and sulfur, $P_{R2}$ is a single atom residue of a payload, wherein the residue is selected from the group consisting of carbon, nitrogen, oxygen and sulfur, $CL_1$ is a cross-linker, x is an integer from 1 to about 100, or 1 to about 50, or 1 to about 40, or 1 to about 20, or 1 to about 10, or 1 to about 5, or is 9, or is 3, or is 2, or is 1; $CL_2$ is a cross-linker that is different from $CL_1$; y is an integer from 1 to about 100, or 1 to about 50, or 1 to about 40, or 1 to about 20, or 1 to about 10, or 1 to about 5, or is 9, or is 3, or is 2, or is 1, with the proviso that x+y is ≥2; and XTEN is a sequence having at least about 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3. In one embodiment of the conjugate of formula VIII, the single atom residue of a payload is from a payload selected from the group consisting of the payloads set forth in Tables 11, 12, 18, 19, and 21. In one embodiment of the conjugate of formula VIII, $CL_1$ and $CL_2$ are each selected from the group of cross-linkers set forth in Table 13. In one embodiment of the conjugate of formula VIII, each $CL_1$ is linked to an lysine epsilon amino group of the XTEN and each $CL_2$ is linked to a cysteine sulfur of the XTEN. In another embodiment of the conjugate of formula VIII, x is 1 and $CL_1$ is linked to the N-terminal amino group of the XTEN and $CL_2$ is linked to either a cysteine sulfur or an lysine epsilon amino group of the XTEN. In another embodiment of the conjugate of formula VIII, $CL_1$ is the reaction product of a first and a second click chemistry reactant selected from Table 15. In another embodiment of the conjugate of formula VIII, $C_2$ is the reaction product of a first and a second click chemistry reactant selected from Table 15. In another embodiment, the invention provides a preparation of the conjugate of formula VIII in which at least about 80%, or at least about 90%, or at least about 91%, or at least about 92%, or at least about 93%, or at least about 94%, or at least about 95% of the XTEN molecules of the preparation of the conjugate have identical sequence length.

In another embodiment, the invention provides a conjugate having the configuration of formula IX:

wherein independently for each occurrence $P_1$ is a payload selected from the group consisting of the payloads set forth in Tables 11, 12, 18, 19, and 21; $P_2$ is a payload selected from the group consisting of the payloads set forth in Tables 11, 12, 18, 19, and 21 and that is different from $P_1$; $CL_1$ is a cross-linker; x is an integer from 1 to about 100, or 1 to about 50, or 1 to about 40, or 1 to about 20, or 1 to about 10, or 1 to about 5, or is 9, or is 3, or is 2, or is 1; $CL_2$ is a cross-linker that is different from $CL_1$; y is an integer from 1 to about 100, or 1 to about 50, or 1 to about 40, or 1 to about 20, or 1 to about 10, or 1 to about 5, or is 9, or is 3, or is 2, or is 1, with the proviso that x+y is ≥2; and XTEN is a sequence having at least about 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3. In one embodiment of the conjugate of formula IX, the single atom residue of a payload is from a payload selected from the group consisting of the payloads set forth in Tables 11, 12, 18, 19, and 21. In one embodiment of the conjugate of formula IX, $CL_1$ and $CL_2$ are each selected from the group of cross-linkers set forth in Table 13. In one embodiment of the conjugate of formula IX, each $CL_1$ is linked to an lysine epsilon amino group of the XTEN and each $CL_2$ is linked to a cysteine sulfur of the XTEN. In another embodiment of the conjugate of formula IX, x is 1 and $CL_1$ is linked to the N-terminal amino group of the XTEN and $CL_2$ is linked to either a cysteine sulfur or an lysine epsilon amino group of the XTEN. In another embodiment of the conjugate of formula IX, $C_L$ is the reaction product of a first and a second click chemistry reactant selected from Table 15. In another embodiment of the conjugate of formula IX, $C_2$ is the reaction product of a first and a second click chemistry reactant selected from Table 15. In one embodiment, the conjugate of formula IX is selected from the group consisting of the conjugates set forth in Table 21. In another embodiment, the invention provides a preparation of the conjugate of formula IX in which at least about 80%, or at least about 90%, or at least about 91%, or at least about 92%, or at least about 93%, or at least about 94%, or at least about 95% of the XTEN molecules of the preparation of the conjugate have identical sequence length.

3. Dimeric, Trimeric, Tetrameric, and Multimeric Configurations of XTEN-Cross-Linkers and XTEN-Payload Conjugates In one aspect, the invention provides conjugates wherein different numbers of XTEN or XTEN-payload conjugation partners are joined by linkers in a numerically-defined configuration; e.g., dimeric, trimeric, tetrameric, or multimeric. As used herein, "precursor" is intended to include components used as reactants in a conjugation reaction leading to an intermediate or final composition, and includes but is not limited to XTEN segments of any length (including the XTEN of Tables 2 and 3 or as depicted in the various formulae, above), XTEN-crosslinkers, XTEN-payload-crosslinker segments, payloads with reactive groups, linkers, and other such components described herein.

Figure 27:
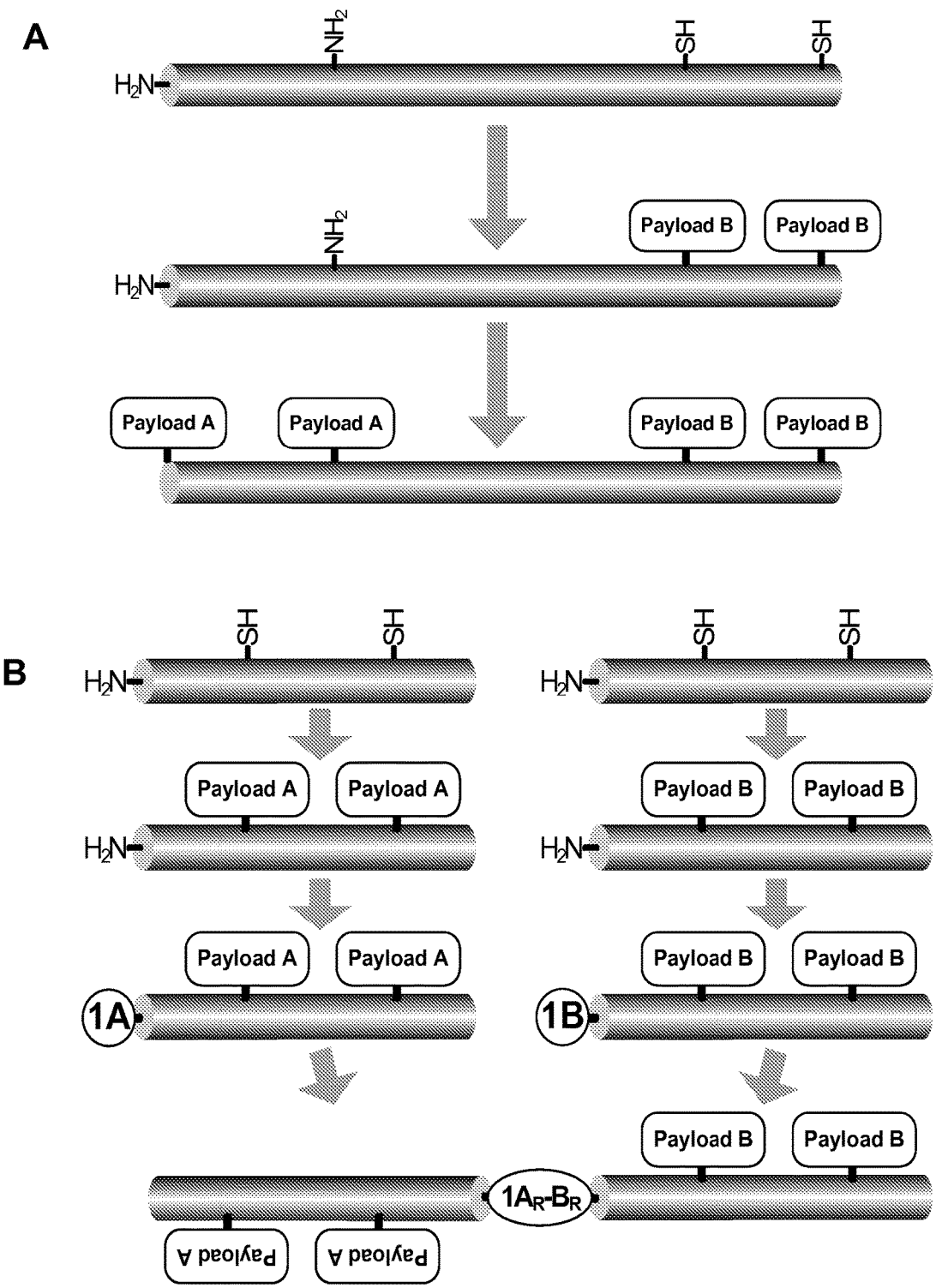
FIG. 27 illustrates the preparation of bispecific conjugates from an XTEN precursor carrying both amino and thiol groups in which many chemistries can be used and the order of payload addition can vary. One can generate linker-conjugates as precursors.

In some embodiments, the invention provides conjugates in which two XTEN or XTEN-payload precursor segments are linked by a divalent cross-linker, resulting in a divalent configuration, such as shown in FIG. 19C and FIG. 27B. In one embodiment of the divalent XTEN-payload conjugate, each XTEN-payload can be a monomeric fusion protein comprising a biologically active peptide or polypeptide, wherein each fusion protein precursor segment is linked to the divalent linker by the alpha-amino group of the N-terminus, resulting in the divalent conjugate. In another embodiment of the divalent XTEN-payload conjugate, each XTEN-payload precursor segment is a monomeric fusion protein comprising a biologically active peptide or polypeptide, wherein each fusion protein is linked to the divalent linker at the C-terminus, resulting in the divalent conjugate. In another embodiment of the divalent XTEN-payload conjugate, each XTEN comprises one or more payloads (that can be a peptide, polypeptide or a drug) conjugated to the XTEN, wherein each XTEN precursor is linked to the other XTEN precursor comprising one or more second, different payload molecules by a divalent linker at the N-terminus, resulting in the divalent conjugate. In another embodiment of the divalent XTEN-payload conjugate, each XTEN comprises one or more payloads (that can be a peptide, polypeptide or a drug) conjugated to the XTEN, wherein each XTEN precursor is linked to the other XTEN precursor comprising one or more second, different payload molecules by a divalent linker by the carboxyl group or a modified group at the C-terminus (including, but not limited to XTEN modified by insertion of a cysteine at the C-terminus), resulting in the divalent conjugate. In the foregoing embodiments of the paragraph, as would be appreciated by one of ordinary skill in the art in light of the present disclosure, there are different approaches to create the precursors to be linked, such as conjugating a linker to a first precursor XTEN-payload and then effecting a second reaction to join the precursor to the reactive group of the terminus the second XTEN-payload precursor. Alternatively, one or both of the XTEN termini can be modified as precursors that can then be joined by click chemistry or by other methods described or illustrated herein, leaving few or no residual atoms to bridge the intersection of the XTEN. In another embodiment, two XTEN-payload precursor sequences are linked by a disulfide bridge using cysteines or thiol groups introduced at or near the termini of the precursor XTEN-payload reactants, resulting in a divalent XTEN-payload conjugate. Exemplary configurations of such divalent conjugates follow.

In one embodiment, the invention provides a conjugate having the configuration of formula X

wherein independently for each occurrence $P_{R1}$ is a single atom residue of a first payload wherein the residue is selected from the group consisting of carbon, nitrogen, oxygen and sulfur; $P_{R2}$ is a single atom residue of a second payload wherein the residue is selected from the group consisting of carbon, nitrogen, oxygen and sulfur, $CL_1$ is a cross-linker; x is an integer from 1 to about 100, or 1 to about 50, or 1 to about 40, or 1 to about 20, or 1 to about 10, or 1 to about 5, or is 9, or is 3, or is 2, or is 1; $CL_2$ is a cross-linker that is different from $CL_1$; y is an integer from 1 to about 100, or 1 to about 50, or 1 to about 40, or 1 to about 20, or 1 to about 10, or 1 to about 5, or is 9, or is 3, or is 2, or is 1, with the proviso that x+y is ≥2; 2×CL is alternatively a divalent cross-linker or the reaction product of a first and a second click chemistry reactant selected from Table 15; $XTEN_1$ is a polypeptide having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3; and $XTEN_2$ is a polypeptide having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3. In one embodiment of the conjugate of formula X, $CL_1$ and $CL_2$ are each selected from the group of cross-linkers set forth in Table 13. In another embodiment of the conjugate of formula X, x is 1 and $CL_1$ is linked to the N-terminal amino group of the XTEN. In another embodiment of the conjugate of formula X, $CL_1$ is the reaction product of a first and a second click chemistry reactant selected from Table 15. In another embodiment of the conjugate of formula X, $C_2$ is the reaction product of a first and a second click chemistry reactant selected from Table 15. In another embodiment of the conjugate of formula X, each $CL_1$ is linked to a cysteine sulfur of the $XTEN_1$ and each $CL_2$ is linked to a cysteine sulfur of $XTEN_2$. In another embodiment of the conjugate of formula X, each $CL_1$ is linked to a lysine epsilon amino group of the $XTEN_1$ and each $CL_2$ is linked to a lysine epsilon amino group of the $XTEN_2$. In another embodiment of the conjugate of formula X, each $CL_1$ is linked to a cysteine sulfur of the $XTEN_1$ and each $CL_2$ is linked to a lysine epsilon amino group of the $XTEN_2$. In another embodiment of the conjugate of formula X, $XTEN_1$ and $XTEN_2$ are identical. In another embodiment of the conjugate of formula X, $XTEN_1$ and $XTEN_2$ are different. In another embodiment, the invention provides a preparation of the conjugate of formula X in which at least about 80%, or at least about 90%, or at least about 91%, or at least about 92%, or at least about 93%, or at least about 94%, or at least about 95% of the XTEN molecules of the preparation of the conjugate have identical sequence length.

In another embodiment, the invention provides a conjugate having the configuration of formula XI

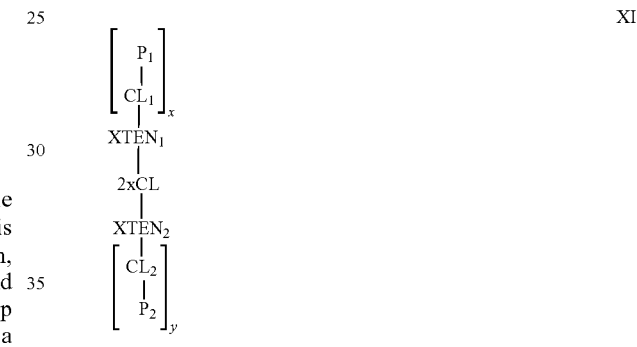

wherein independently for each occurrence $P_1$ is a first payload selected from the group of payloads set forth in Tables 11, 12, 18, 19, and 21; $P_2$ is a second payload selected from the group of payloads set forth in Tables 11, 12, 18, 19, and 21 and that is different from $P_1$; $CL_1$ is a cross-linker, x is an integer from 1 to about 100, or 1 to about 50, or 1 to about 40, on to about 20, or 1 to about 10, or 1 to about 5, or is 9, or is 3, or is 2, or is 1; $CL_2$ is a cross-linker that is different from $CL_1$; y is an integer from 1 to about 100, or 1 to about 50, or 1 to about 40, or 1 to about 20, or 1 to about 10, or 1 to about 5, or is 9, or is 3, or is 2, or is 1, with the proviso that x+y is ≥2; 2×CL is alternatively a divalent cross-linker or the reaction product of a first and a second click chemistry reactant selected from Table 15; $XTEN_1$ is a first substantially homogeneous XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3; and $XTEN_2$ is a first substantially homogeneous having at least 80%0, or at least about 90%0, or at least about 91%, or at least about 92%, or at least about 93%, or at least about 94%, or at least about 95%, or at least about 96%, or at least about 97%, or at least about 98%, or at least about 99%0, or having 100% sequence identity to a sequence selected from the group of sequences set forth in Tables 2 and 3. In one embodiment of the conjugate of formula XI, $CL_1$ and $CL_2$ are each selected from the group of cross-linkers set forth in Table 13. In another embodiment of the conjugate of formula XI, x is 1 and $CL_1$ is linked to the N-terminal amino group of the XTEN. In another embodiment of the conjugate of formula XI, $CL_1$ is the reaction product of a first and a second click chemistry reactant selected from Table 15. In another embodiment of the conjugate of formula XI, $C_2$ is the reaction product of a first and a second click chemistry reactant selected from Table 15. In another embodiment of the conjugate of formula XI, each $CL_1$ is linked to a cysteine sulfur of the $XTEN_1$ and each $CL_2$ is linked to a cysteine sulfur of $XTEN_2$. In another embodiment of the conjugate of formula XI, each $CL_1$ is linked to a lysine epsilon amino group of the $XTEN_1$ and each $CL_2$ is linked to a lysine epsilon amino group of the $XTEN_2$. In another embodiment of the conjugate of formula XI, each $CL_1$ is linked to a cysteine sulfur of the $XTEN_1$ and each $CL_2$ is linked to a lysine epsilon amino group of the $XTEN_2$. In another embodiment of the conjugate of formula XI, $XTEN_1$ and $XTEN_2$ are identical. In another embodiment of the conjugate of formula XI, $XTEN_1$ and $XTEN_2$ are different. In one embodiment, the conjugate of formula XI is selected from the group consisting of the conjugates set forth in Table 21. In another embodiment, the invention provides a preparation of the conjugate of formula XI in which at least about 80%, or at least about 90%, or at least about 91%, or at least about 92%, or at least about 93%, or at least about 94%, or at least about 95% of the respective $XTEN_1$ and $XTEN_2$ molecules of the preparation of the conjugate have identical sequence length.

Figure 21:
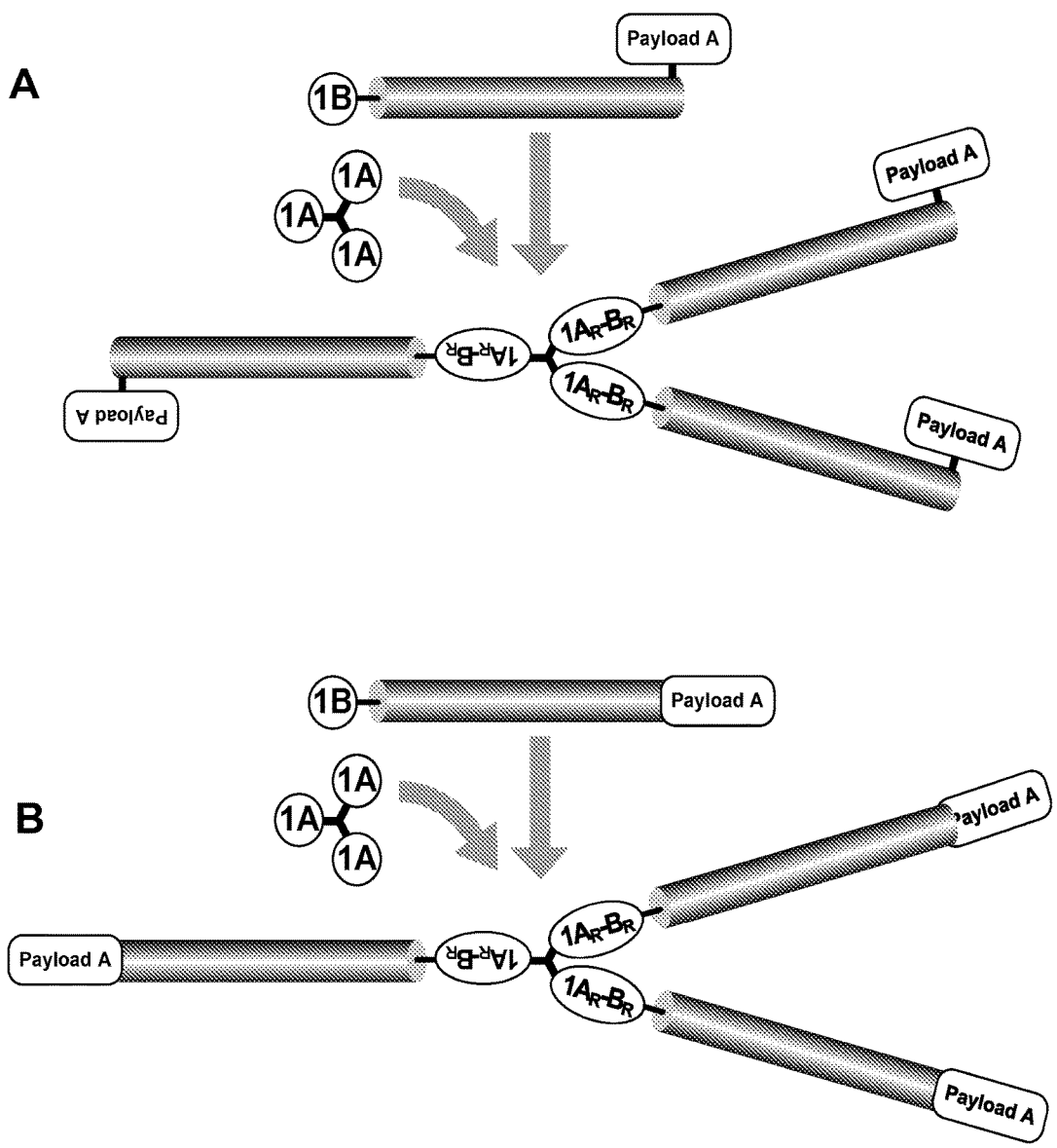
FIG. 21 illustrates examples of multimeric conjugates.
Figure 22:
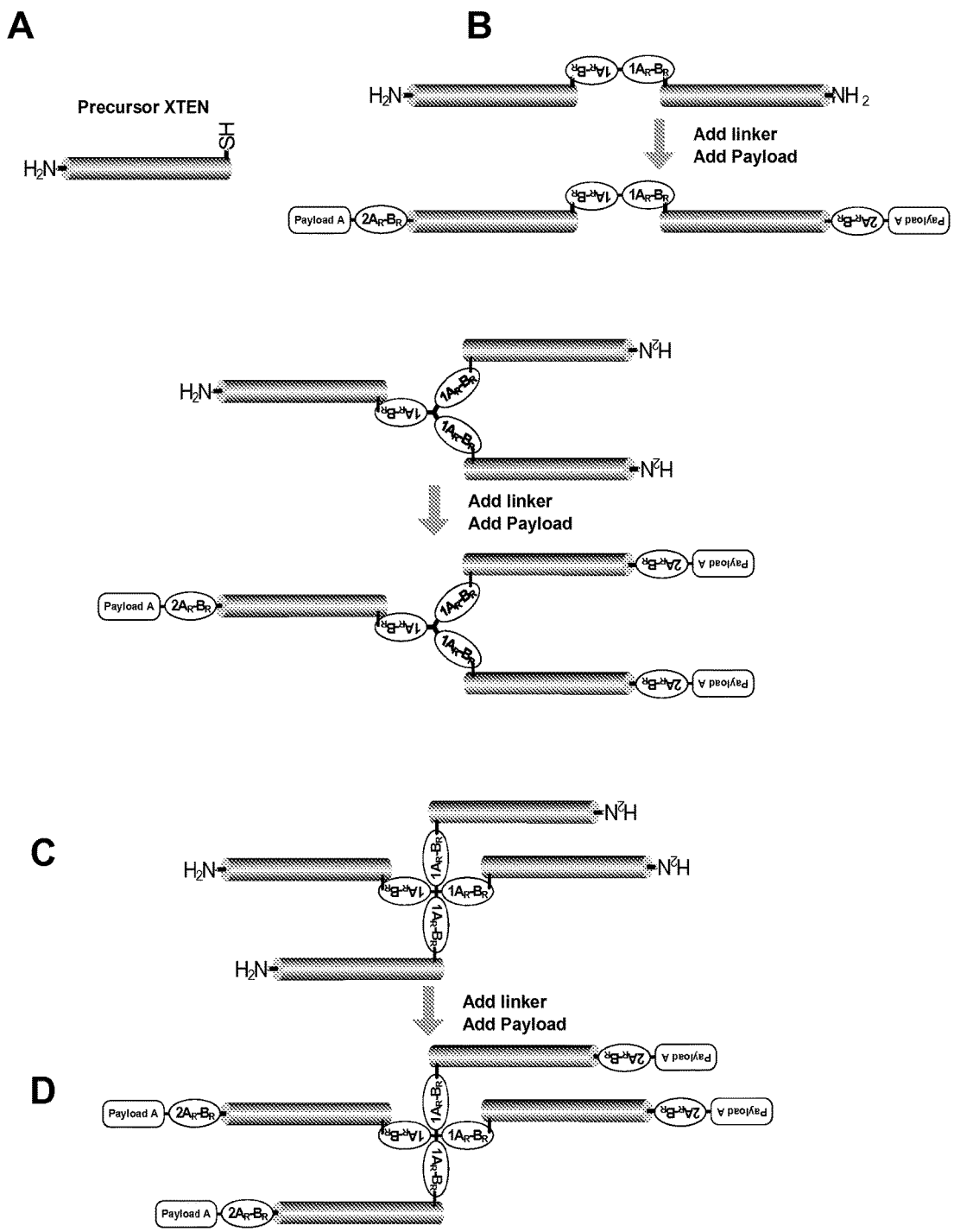
FIG. 22 illustrates examples of multivalent XTEN conjugates that can originate from XTEN precursors with a single cysteine. The amino group in the XTEN precursor acts as reactive group 2B and the thiol group as reactive group 1B. The XTEN precursor can be cross-linked using cross-linker that can react with group 1B. The valency of the cross-linker controls the valency of the resulting intermediate. This cross-linked intermediate can be reacted with a payload carrying a reactive group 2A that can react with the amino group forming the conjugation link 2A-BR.
Figure 23:
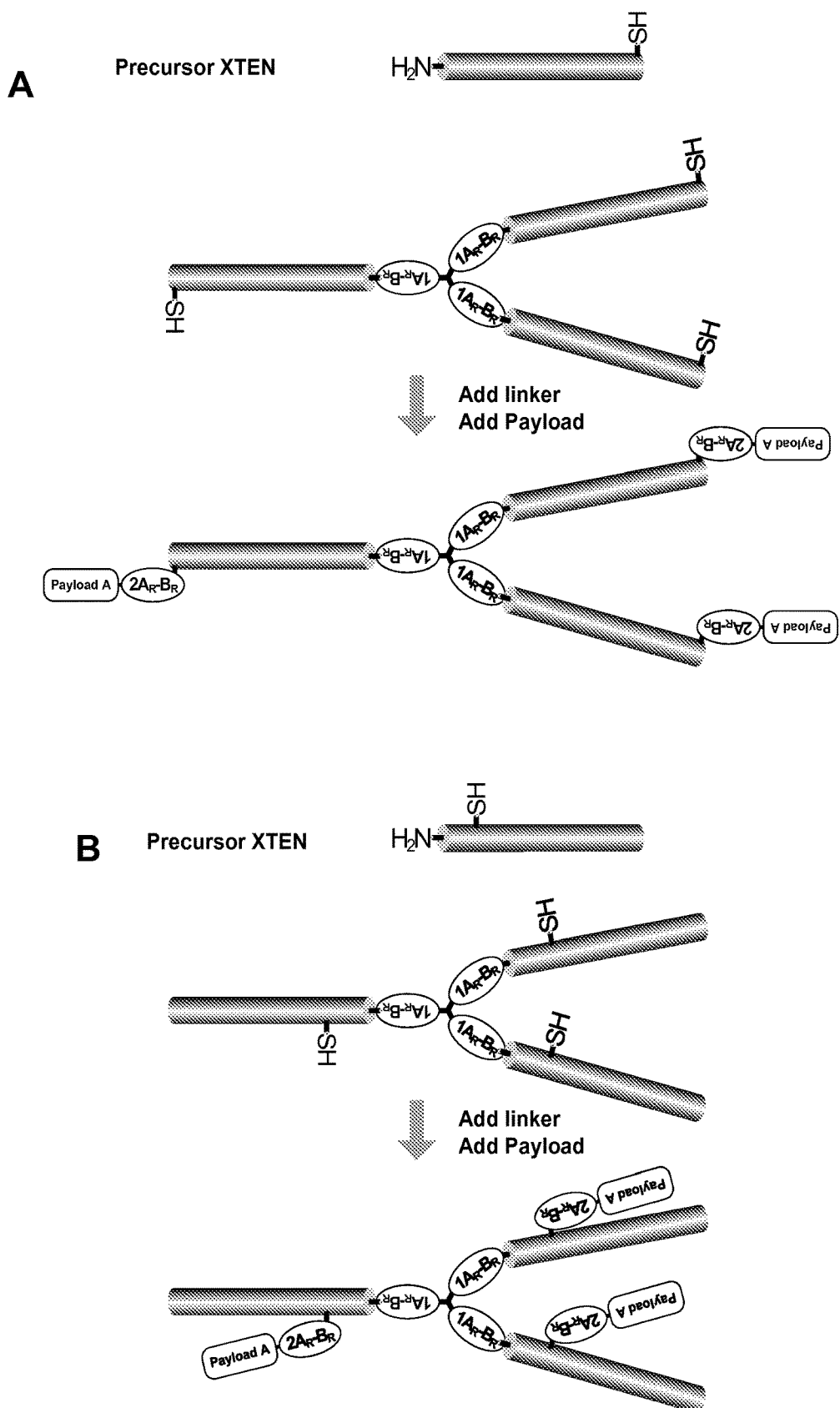
FIG. 23 illustrates examples of multivalent XTEN conjugates that can originate from XTEN precursors with a single cysteine. The amino group in the XTEN precursor acts as reactive group 1B and the thiol group as reactive group 2B. The XTEN precursor can be cross-linked using cross linker that can react with group 1B. The valency of the cross linker controls the valency of the resulting intermediate. This cross linked intermediate can be reacted with a payload carrying a reactive group 2A that can react with the thiol group forming the conjugation link 2A-BR.

In other embodiments, the invention provides XTEN-linker and XTEN-linker payload conjugates with a trimeric configuration, such as shown in FIGS. 21-23.

The invention provides trimeric conjugates in which three XTEN-cross-linker conjugates are linked by a trivalent linker, resulting in a trimeric XTEN-cross-linker configuration. In one embodiment, the invention provides a trimeric XTEN-crosslinker having the configuration of formula XII

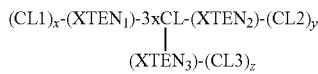

XII wherein independently for each occurrence 3×CL is the trivalent cross-linker, CL1 is the first cross-linker conjugated to XTEN1, CL2 is the second cross-linker conjugated to XTEN2, CL3 is the third cross-linker conjugated to XTEN3, x is an integer of 1 to about 10, y is an integer of 1 to about 10, z is an integer of 1 to about 10 with the proviso that x+y+z is >3, $XTEN_1$ is the first XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3; $XTEN_2$ is the second XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3; and $XTEN_3$ is the third XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3 wherein $XTEN_1$, $XTEN_2$, and $XTEN_3$ are the same or are different XTEN sequences. In one embodiment of the conjugate of formula XII, CL1, CL2, and CL3 are each selected from the group consisting of the cross-linkers set forth in Table 13, and are the same or are different. In one embodiment, the conjugate of formula XII further comprises a single atom residue of a first payload conjugated to each cross-linker of the first substantially homogeneous XTEN wherein the residue is selected from the group consisting of carbon, nitrogen, oxygen and sulfur, a single atom residue of a second payload conjugated to each cross-linker of the second substantially homogeneous XTEN wherein the residue is selected from the group consisting of carbon, nitrogen, oxygen and sulfur, and a single atom residue of a third payload conjugated to each cross-linker of the third substantially homogeneous XTEN wherein the residue is selected from the group consisting of carbon, nitrogen, oxygen and sulfur.

In another embodiment, the invention provides trimeric conjugates in which three XTEN-payload precursors are linked by a trivalent linker, resulting in a trimeric XTEN-payload configuration, such as shown in FIGS. 21 and 97-106. In one embodiment, the invention provides a trimeric XTEN-crosslinker having the configuration of formula XIII

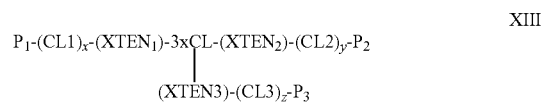

XIII wherein independently for each occurrence 3×CL is the trivalent cross-linker is selected from the group of trivalent cross-linkers set forth in Tables 13 and 14; $P_1$ is conjugated to each cross-linker of the first XTEN and is selected from the group consisting of the payloads set forth in Tables 11, 12, 18 and 21, P2 is a second payload conjugated to each cross-linker of the second XTEN and is selected from the group consisting of the payloads set forth in Tables 11, 12, 18 and 21, wherein the payload is the same or is different from the first payload, and $P_3$ is a third payload conjugated to each cross-linker of the third XTEN and is selected from the group consisting of the payloads set forth in Tables 11, 12, 18 and 21, wherein the payload is the same or is different from the first or the second payload; $CL_1$ is the first cross-linker; x is an integer from 1 to about 100, or 1 to about 50, or 1 to about 40, or 1 to about 20, or 1 to about 10, or 1 to about 5, or is 9, or is 3, or is 2, or is 1; CL2 is a second cross-linker; y is an integer from 1 to about 100, or 1 to about 50, or 1 to about 40, or 1 to about 20, or 1 to about 10, or 1 to about 5, or is 9, or is 3, or is 2, or is 1; and z is an integer from 1 to about 100, or 1 to about 50, or 1 to about 40, or 1 to about 20, or 1 to about 10, or 1 to about 5, or is 9, or is 3, or is 2, or is 1, with the proviso that x+y+z is ≥3; $XTEN_1$ is the first XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3; $XTEN_2$ is the second XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3; and XTEN₃ is the third XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3 wherein $XTEN_1$, $XTEN_2$ and $XTEN_3$ are the same or are different XTEN sequences. In some embodiments, the conjugate of formula XIII further comprises a first payload wherein the payload is a targeting moiety with specific binding affinity to a target, wherein the targeting moiety is selected from the group consisting of the targeting moieties set forth in Tables 17-19 and 21, and at least one other of the payloads is a drug wherein the drug is selected from the group consisting of the drugs set forth in Table 11, Table 19, and Table 21. In one embodiment of the foregoing, the targeting moiety is LHRH or folate and the drug is selected from doxorubicin, paclitaxel, auristatin, monomethyl auristatin E (MMAE), monomethyl auristatin F, maytansine, dolastatin, calicheamicin, vinca alkaloid, camptothecin, mitomycin C, epothilone, hTNF, 11-12, bortezomib, ranpirnase, pseudomonas exotoxin, SN-38, and rachelmycin. In another embodiment of the trimeric XTEN conjugate composition, the composition has the configuration of formula XIV:

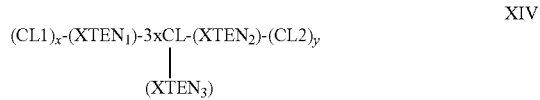

wherein independently for each occurrence; 3×CL is the trivalent cross-linker; CL1 is the first cross-linker conjugated to $XTEN_1$; CL2 is the second cross-linker conjugated to $XTEN_2$; x is an integer of 1 to about 10; y is an integer of 1 to about 10 with the proviso that x+y is ≥2; $XTEN_1$ is the first XTEN; $XTEN_2$ is the second XTEN; and $XTEN_3$ is the third XTEN wherein the XTEN is selected from the group consisting of the sequences set forth in Table 2. In one embodiment of the trimeric XTEN conjugate composition of formula XIV, the composition further comprises a single atom residue of a first payload conjugated to each first cross-linker of the first XTEN wherein the residue is selected from the group consisting of carbon, nitrogen, oxygen and sulfur; and a single atom residue of a second payload conjugated to each second cross-linker of the second XTEN wherein the residue is selected from the group consisting of carbon, nitrogen, oxygen and sulfur. In another embodiment of the trimeric XTEN conjugate composition of formula XIV, the composition further comprises a first payload conjugated to each first cross-linker of the first XTEN selected from the group consisting of the payloads set forth in Tables 6, 7, 18 and 21; and a second payload conjugated to each second cross-linker of the second XTEN selected from the group consisting of the payloads set forth in Tables 6, 7, 18 and 21, wherein the payload is the same or is different from the first payload. In one embodiment of the foregoing, the first payload is a targeting moiety with specific binding affinity to a target, wherein the targeting moiety is selected from the group consisting of the targeting moieties set forth in Tables 17-19 and 21, and the second payloads is a drug selected from the group consisting of the drugs set forth in Table 6, Table 18, and Table 21. In another embodiment of the foregoing, the first payload is a targeting moiety is selected from the group consisting of LHRH and folate, and the second payload is a drug is selected from the group consisting of doxorubicin, paclitaxel, auristatin, monomethyl auristatin E (MMAE), monomethyl auristatin F, maytansine, dolastatin, calicheamicin, vinca alkaloid, camptothecin, mitomycin C, epothilone, hTNF, Il-12, bortezomib, ranpirnase, pseudomonas exotoxin, SN-38, and rachelmycin. In one embodiment of the foregoing, the first payload is a drug selected from the group consisting of the drugs of Table 11 and the proteins of Table 12 and the second payload is different from the first payload and is selected from the group consisting of the drugs of Table 11 and the proteins of Table 12. In another embodiment of the foregoing, the first payload and the second payload are identical and are selected from the group consisting of the drugs of Table 11 and the proteins of Table 12. In another embodiment of the trimeric XTEN conjugate composition, the composition has the configuration of formula XV:

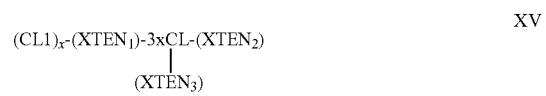

wherein independently for each occurrence; 3×CL is the trivalent cross-linker; CL1 is the first cross-linker conjugated to $XTEN_1$; x is an integer of 1 to about 10; $XTEN_1$ is the first XTEN wherein the XTEN is selected from the group consisting of the sequences set forth in Table 3; $XTEN_2$ is the second XTEN wherein the XTEN is selected from the group consisting of the sequences set forth in Table 2; and $XTEN_3$ is the third XTEN wherein the XTEN is selected from the group consisting of the sequences set forth in Table 2. In one embodiment of the trimeric XTEN conjugate composition configured as formula XV, the composition further comprises a single atom residue of a first payload conjugated to each first cross-linker of the first XTEN wherein the residue is selected from the group consisting of carbon, nitrogen, oxygen and sulfur. In one embodiment of the trimeric XTEN conjugate composition configured as formula XV, the composition further comprises a first payload conjugated to each first cross-linker of the first XTEN selected from the group consisting of the payloads set forth in Tables 6, 7, 18 and 21.

In another embodiment of the trimeric XTEN-payload conjugate, each XTEN-payload can be a monomeric fusion protein comprising a biologically active peptide or polypeptide, wherein the fusion protein is linked to the trivalent linker at an amino group or a thiol group of the XTEN. In another embodiment of the trimeric XTEN-payload conjugate, each XTEN-payload can be a conjugate of a payload linked to the XTEN, which can be a biologically active peptide or polypeptide or a pharmacologically active small molecule or toxin, linked to the XTEN that, in turn, is linked to the trivalent linker at the N-terminus of the XTEN. In the foregoing XTEN-linker-payload embodiments hereinabove described in this paragraph, the three payloads can be identical or they can be different. In one embodiment of the trimeric XTEN-payload conjugate, the conjugate comprises at least one biologically active protein and at least one drug linked to different XTEN that, in turn, is linked to the trivalent linker at the N-terminus of the XTEN. In a particular embodiment of the foregoing configuration, the at least one biologically active protein is a targeting moiety and the at least one drug is a toxin including, but not limited to doxorubicin, paclitaxel, auristatin, monomethyl auristatin E, monomethyl auristatin F, maytansine, dolastatin, calicheamicin, vinca alkaloid, camptothecin, mitomycin C, epothilone, hTNF, Il-12, bortezomib, ranpirnase, pseudomonas exotoxin, SN-38, and rachelmycin. Depending on the position of the thiol or the epsilon amino group in the XTEN, one can control if the payload is interior to (as shown in FIG. 23B) or at the terminus of the cross-linked XTEN (as shown in FIG. 23A). In the foregoing embodiment, exemplary, non-limiting targeting moieties include LHRH, folate, octreotide, pasireotide, bombesin, monoclonal antibodies, scFV, centryins, and the antibody fragments, scaffolds and mimetics of Table 17. Exemplary configurations of such trimeric conjugates follow.

The invention further provides XTEN-linker and XTEN-linker payload conjugates with a tetrameric configuration. In one embodiment, the invention provides conjugates in which four XTEN sequences are linked by a tetraravalent linker, resulting in a tetraramic XTEN-crosslinker configuration, such as shown in FIG. 22D. Non-limiting examples of tetravalent linkers include a tetraravalent-thiol, a quadravalent-N-maleimide linker such as described in U.S. Pat. No. 7,524,821, or an antibody or antibody fragment with four reactive groups.

The invention provides conjugates in which four XTEN-cross-linker precursor sequences are linked by a tetrarvalent linker, resulting in a tetravalent XTEN-cross-linker configuration. In one embodiment, the invention provides a tetrameric XTEN-crosslinker having the configuration of formula XVI

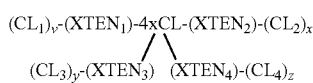

XVI wherein independently for each occurrence: 4×CL is the tetravalent cross-linker, $CL_1$ is the first cross-linker conjugated to $XTEN_1$; $CL_2$ is the second cross-linker conjugated to $XTEN_2$; $CL_3$ is the third cross-linker conjugated to $XTEN_3$; $CL_4$ is the fourth cross-linker conjugated to $XTEN_4$; v is an integer of 1 to about 10; x is an integer of 1 to about 10; y is an integer of 1 to about 10; z is an integer of 1 to about 10 with the proviso that x+y+z is ≥4; $XTEN_1$ is the first XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3; $XTEN_2$ is the second XTEN having at least 80%, or at least about 90%, or at least about 91%, or at least about 92%, or at least about 93%, or at least about 94%, or at least about 95%, or at least about 96%, or at least about 97%0/or at least about 98%, or at least about 99%, or having 100% sequence identity to a sequence selected from the group of sequences set forth in Tables 2 and 3; $XTEN_3$ is the third XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3 wherein $XTEN_1$, $XTEN_2$, and $XTEN_3$ are the same or are different XTEN sequences; $XTEN_4$ is the fourth XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3 wherein $XTEN_1$, $XTEN_2$, $XTEN_3$ and $XTEN_4$ are the same or are different XTEN sequences.

Figure 105:
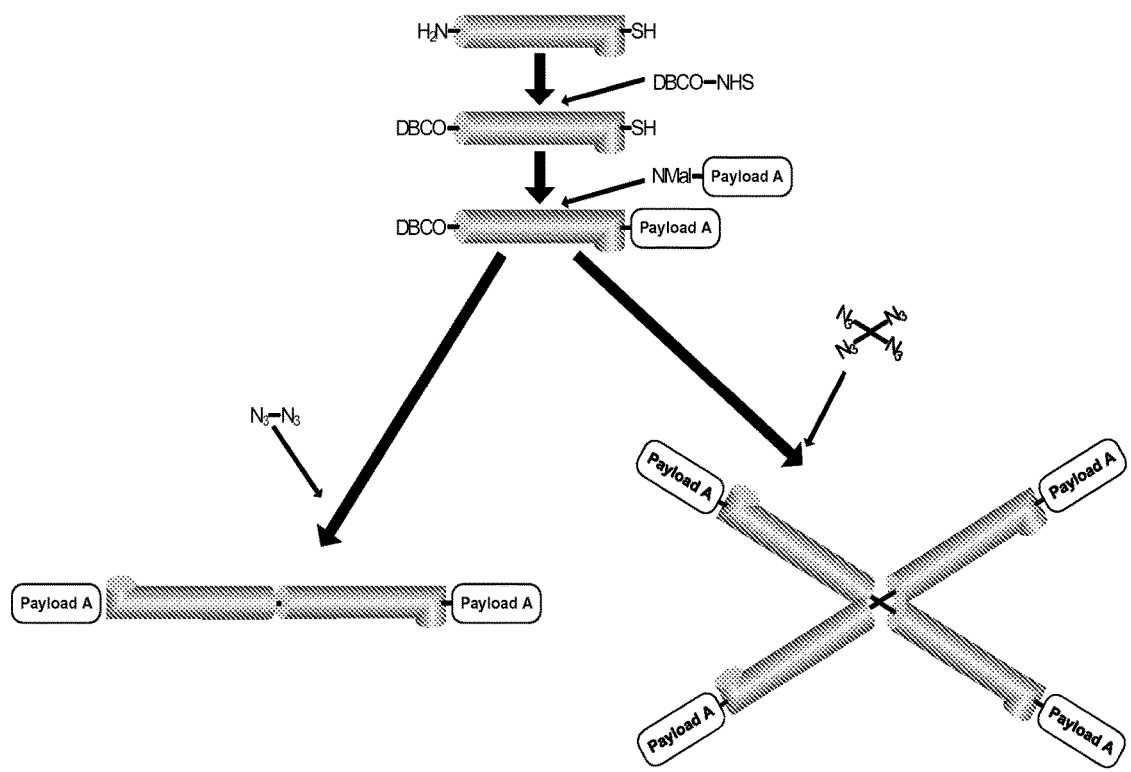
FIG. 105 illustrates a scheme for synthesis of a conjugate having a dimeric or tetrameric branched XTEN and Payload A molecules. An intermediate is produced by adding DBCO to the thiol group of an XTEN using N-maleimide functional group followed by the addition Payload A to the amino group of the XTEN using NHS (the order of these two steps can be inverted). Subsequently the intermediate is multimerized by addition of azide cross-linkers. Use of a divalent cross-linker yields the dimeric configuration, and a tetravalent cross-linker yields the tetrameric configuration of the final product.
Figure 106:
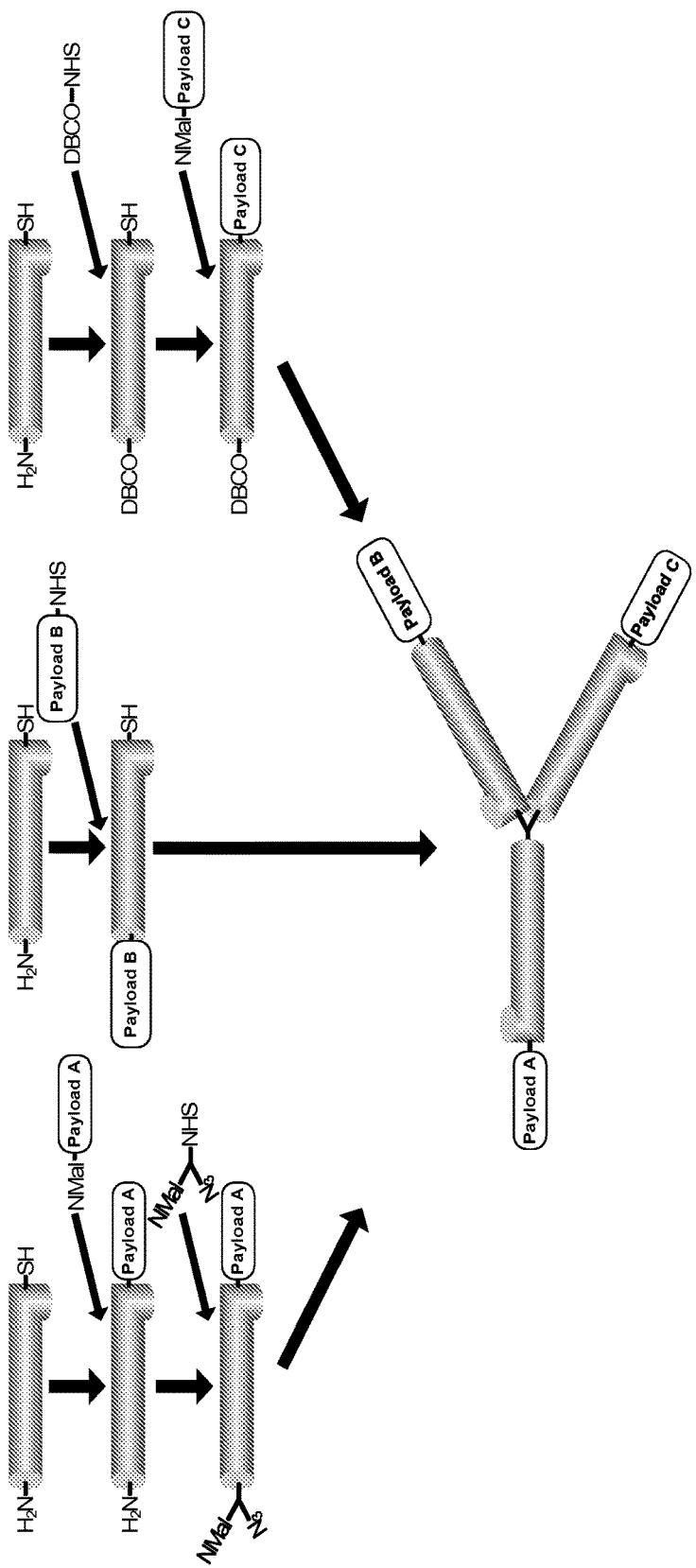
FIG. 106 illustrates a scheme for synthesis of a conjugate having a branched XTEN and three different payloads. An intermediate is produced by adding Payload A to the thiol group of an XTEN using N-maleimide functional group, followed by the addition of a trifunctional cross linker (one azide group, one N-maleimide group and one carboxyl group that is activated by NHS) to the alpha amino-group (the order of these two steps can be inverted). A second intermediate is produced by adding Payload B to the free thiol group of an XTEN via an N-maleimide functional group. A third intermediate is produced by adding DBCO to the alpha amino-group of an XTEN via NHS activation followed by the addition of Payload C to the free thiol group using a N-maleimide group (the order of these two steps can be inverted). The three intermediates are reacted with each other to form the final XTEN-payload conjugate.

The invention provides conjugates in which four XTEN-payload precursor sequences are linked by a tetravalent linker, resulting in a tetraravalent XTEN-payload configuration as shown in FIGS. 22C and 105. In one embodiment, the invention provides a tetrameric XTEN-payload having the configuration of formula XVII

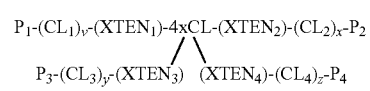

XVII wherein independently for each occurrence: 4×CL is the tetravalent cross-linker, $P_1$ is conjugated to each cross-linker of the first XTEN and is selected from the group consisting of the payloads set forth in Tables 11, 12, 18 and 21, P2 is a second payload conjugated to each cross-linker of the second XTEN and is selected from the group consisting of the payloads set forth in Tables 11, 12, 18 and 21, wherein the payload is the same or is different from the first payload, $P_3$ is a third payload conjugated to each cross-linker of the third XTEN and is selected from the group consisting of the payloads set forth in Tables 11, 12, 18 and 21, wherein the payload is the same or is different from the first or the second payload; $P_4$ is a fourth payload conjugated to each cross-linker of the fourth XTEN and is selected from the group consisting of the payloads set forth in Tables 11, 12, 18 and 21, wherein the payload is the same or is different from the first, the second or the third payload; $CL_1$ is the first cross-linker conjugated to $XTEN_1$; $CL_2$ is the second cross-linker conjugated to $XTEN_2$; $CL_3$ is the third cross-linker conjugated to $XTEN_3$; $CL_4$ is the fourth cross-linker conjugated to $XTEN_4$; v is an integer of 1 to about 10; x is an integer of 1 to about 10; y is an integer of 1 to about 10; z is an integer of 1 to about 10 with the proviso that x+y+z is ≥4; $XTEN_1$ is the first XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3; $XTEN_2$ is the second XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3; $XTEN_3$ is the third XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3 wherein $XTEN_1$, $XTEN_2$, and $XTEN_3$ are the same or are different XTEN sequences; $XTEN_4$ is the fourth XTEN having at least 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Tables 2 and 3 wherein $XTEN_1$, $XTEN_2$, $XTEN_3$ and $XTEN_4$ are the same or are different XTEN sequences.

In another embodiment of the tetraravalent XTEN-payload conjugate, each XTEN-payload can be a monomeric fusion protein comprising a biologically active peptide or polypeptide, wherein the fusion protein is linked to the tetraravalent linker at an amino group or a thiol group of the XTEN. In another embodiment of the tetraravalent XTEN-payload conjugate, each XTEN-payload can be a conjugate of a payload, which can be a biologically active peptide or polypeptide or a pharmacologically active small molecule or toxin, linked to the XTEN that, in turn, is linked to the tetraravalent linker by the N-terminus of the XTEN. In the foregoing XTEN-linker-payload embodiments hereinabove described in this paragraph, the four payloads can be identical or they can be different. In a particular embodiment of the foregoing configuration, the at least one biologically active protein is a targeting moiety and the at least one drug is a toxin including, but not limited to doxorubicin, paclitaxel, auristatin, maytansine, dolastatin, calicheamicin, vinca alkaloid, camptothecin, mitomycin C, epothilone, hTNF, 11-12, bortezomib, ranpirnase, pseudomonas exotoxin, SN-38, and rachelmycin. Depending on the position of the thiol or the epsilon amino group in the XTEN, one can control if the payload is interior to or at the terminus of the cross-linked XTEN.

4. Multivalent Configurations with Four or More XTEN-Payloads

Figure 24:
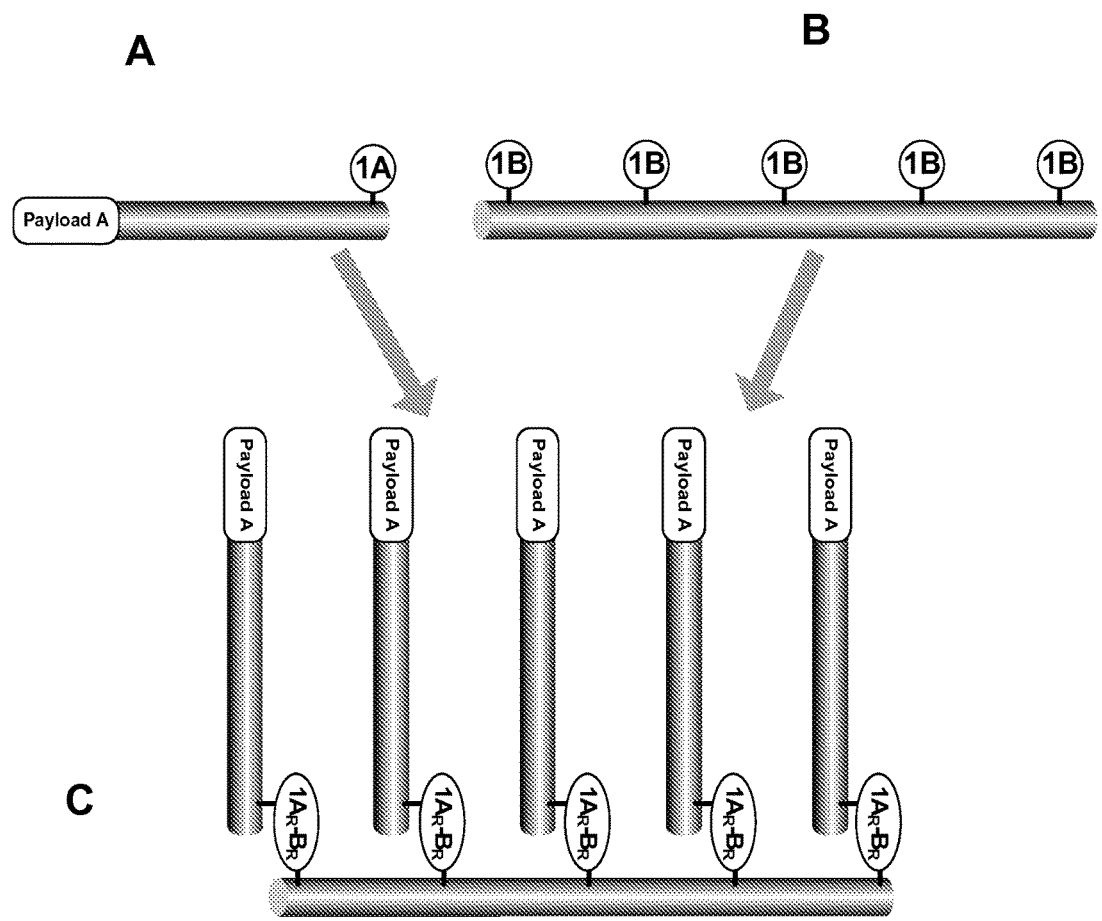
FIG. 24 illustrates an example of the creation of a "comb" configuration.
Figure 25:
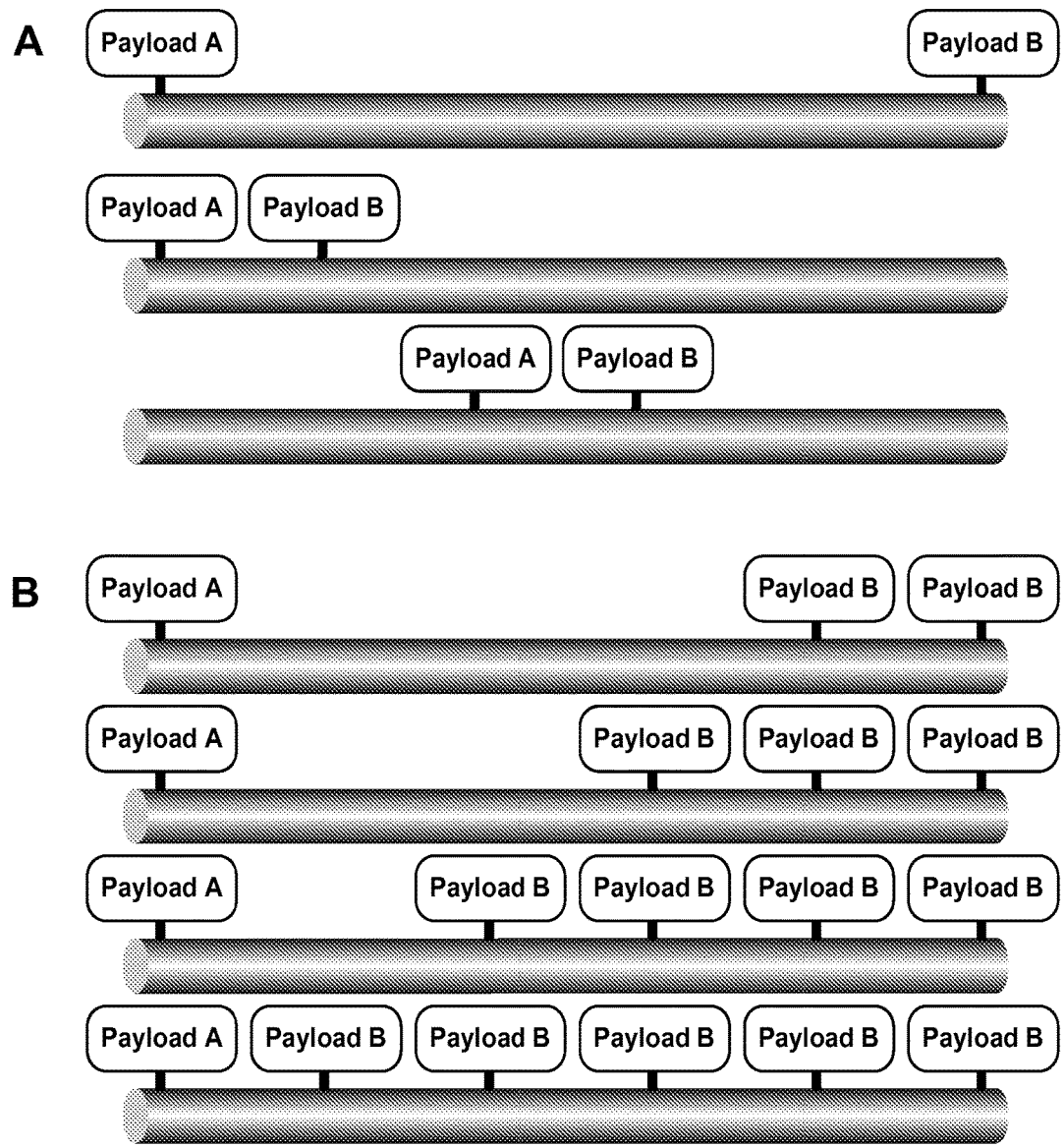
FIG. 25 illustrates various configurations of bispecific conjugates with two payloads.
Figure 26:
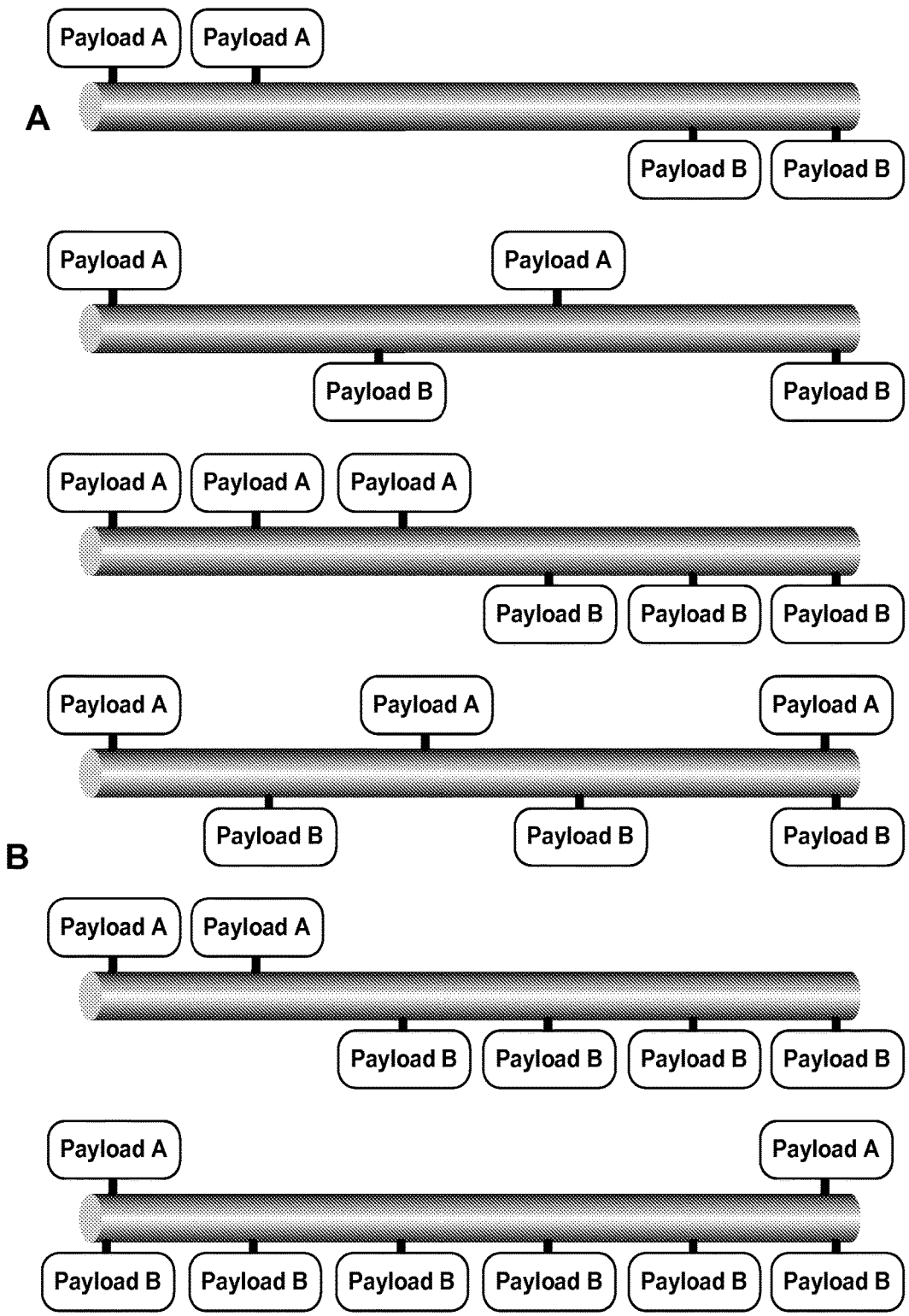
FIG. 26 illustrates various examples of conjugates with high valency. Conjugations sites of payloads can grouped (FIG. 26A) or interspersed (FIG. 26B).

Using XTEN of Table 3, compositions are contemplated containing four or more XTEN-payload molecules linked to the cysteine- or lysine-engineered backbone, resulting in a "comb" multivalent configuration, or linking multiple branched precursors to make a "dendrimer" configuration, as illustrated in FIG. 7. In one embodiment, the multivalent configuration conjugate is created by reacting a cysteine- or lysine-engineered XTEN with an XTEN-payload comprising a linker appropriate for reaction with the cysteine- or lysine-engineered XTEN (as illustrated in FIG. 24), resulting in the final product. In another embodiment, the multivalent configuration conjugate is created by reacting a cysteine- or lysine-engineered XTEN with linkers with an XTEN-payload comprising a cysteine or a primary or epsilon amino group appropriate for reaction with the linker linked to the cysteine- or lysine-engineered XTEN, resulting in the final product. In the embodiments, the valency of the final product is controlled by the number of reactive groups incorporated into the XTEN, whether a reactive amino acid or linker. Additionally, it is contemplated that the final product can be designed to locate the payload either close to the XTEN termini, which improves interactions with its ligand, or close to the branch points to shield the payload and reduce the degree of interaction with the ligand.

5. Bispecific Payload Configurations on Monomer XTEN Backbone

In another aspect, the invention provides conjugates containing two different payload molecules linked to a single cysteine- and lysine-engineered XTEN backbone, as illustrated in FIG. 27A, resulting in a bivalent conjugate. In one embodiment, the bivalent configuration conjugate is created by reacting the engineered XTEN, such as those specifically provided in Table 3, with a first XTEN-payload comprising a linker appropriate for reaction with the cysteine-engineered XTEN, followed by a second reaction with a second XTEN-payload comprising a linker appropriate for reaction with the lysine-engineered XTEN, resulting in the final product. The number and location of payloads is controlled by the design of the engineered XTEN, with the placement of the reactive thiol or amino group being determinative. In one embodiment, the bivalent conjugate comprises a single molecule of a first payload and a single molecule of a second payload linked to the cysteine-lysine-engineered XTEN by linkers. In another embodiment, the bivalent conjugate comprises one, or two, or three, or four, or five molecules of a first payload and a single molecule of a second payload linked to the cysteine-lysine-engineered XTEN by linkers. In another embodiment, the bivalent conjugate comprises one, or two, or three, or four, or five molecules of a first payload and one, or two, or three, or four, or five molecules of a second payload linked to the cysteine-lysine-engineered XTEN by linkers.

In another embodiment, the bivalent configuration conjugate is created by reacting the cysteine- and lysine-engineered XTEN, such as those of Table 3, with a first linker appropriate for reaction with the cysteine-engineered XTEN, followed by a second reaction with a linker appropriate for reaction with the lysine-engineered XTEN, then reacting the XTEN-crosslinker backbone with a first payload with a thiol reactive group capable of reacting with the first linker, followed by a reaction of a second payload with an amino group capable of reacting with the second cross-linker, resulting in the final product.

6. XTEN-Cross-Linker and XTEN-Payload Conjugates with Spacer and Release Groups

In another aspect, the invention provides XTEN-cross-linker and XTEN-payload conjugates configured with one or more spacers incorporated into or adjacent to the XTEN that are designed to incorporate or enhance a functionality or property to the composition, or as an aid in the assembly or manufacture of the compositions. Such properties include, but are not limited to, inclusion of a sequence capable of being proteolytically cleaved or a labile functional group to permit release of the payload, or a spacer can be introduced between an XTEN sequence and a payload component to decrease steric hindrance such that the payload component may interact appropriately with its target ligand.

In one embodiment, the one or more spacers are incorporated into the linkers of the subject conjugates. For spacers and methods of identifying desirable spacers, see, for example, George, et al. (2003) Protein Engineering 15:871-879, specifically incorporated by reference herein. In one embodiment, the spacer comprises one or more peptide sequences that are between 1-50 amino acid residues in length, or about 1-25 residues, or about 1-10 residues in length. Spacer sequences, exclusive of cleavage sites, can comprise any of the 20 natural L-amino acids, and will preferably have XTEN-like properties in that the majority of residues will be hydrophilic amino acids that are sterically unhindered. The spacer can be polyglycines or polyalanines, or is predominately a mixture of combinations of glycine, serine and alanine residues. In one embodiment, the spacer sequence is a sequence from Table 15. In another embodiment, the spacer sequence is GPEGPS (SEQ ID NO: 580).

In addition, spacer sequences are designed to avoid the introduction of T-cell epitopes which can, in part, be achieved by avoiding or limiting the number of hydrophobic amino acids utilized in the spacer; the determination of epitopes is described above and in the Examples.

In one embodiment, the spacer comprises a release group that permits the release of the payload from the conjugate. In another embodiment, the cross-linker comprises a release group that permits the release of the payload from the conjugate. The release group may be any labile group providing for such a releasable attachment. In one embodiment, the release group is a chemically cleavable linkage or labile chemical linkage. Such linkages may typically be cleaved by methods that are well known to those of skill in the art, such as by acid, base, oxidation, reduction, displacement or elimination. In a particular embodiment, the chemistry cleavable linkage comprises a modified base, a modified sugar, a disulfide bond, a chemically cleavable group incorporated into the cross-linker or spacer. Some examples of these linkages are described in PCT WO 96/37630 and U.S. Pat. No. 7,132,519, incorporated herein by reference. Release groups encompassed by the invention also include groups or linkages cleavable by an enzyme. Enzymatically-cleavable release groups include phosphodiester or amide linkages as well as restriction endonuclease recognition sites. In one embodiment, the invention provides compositions comprising one or more payloads in which a cleavable linker of valine-citrulline is between the payload and the XTEN, permitting cleavage by cathepsin when the composition is internalized intracellularly; e.g., inside a tumour cell. In another embodiment, release groups are cleavable by nucleases. These nucleases may typically be an exonuclease or a restriction endonuclease. Typical exonucleases include exonucleases specific for both double-stranded and single-stranded polynucleic acids. Additionally, restriction endonucleases encompassed by certain embodiments include Type IIS and Type II restriction endonucleases. In other embodiments the release group may be a sequence that is cleavable by a protease, wherein the sequence is selected from the sequences set fort in Table 9. Typical proteases acting on sequences suitable for inclusion in the inventive compositions include endoproteinases, including the proteinases of Table 9.

7. Libraries of XTEN-Payload Configurations

Figure 34:
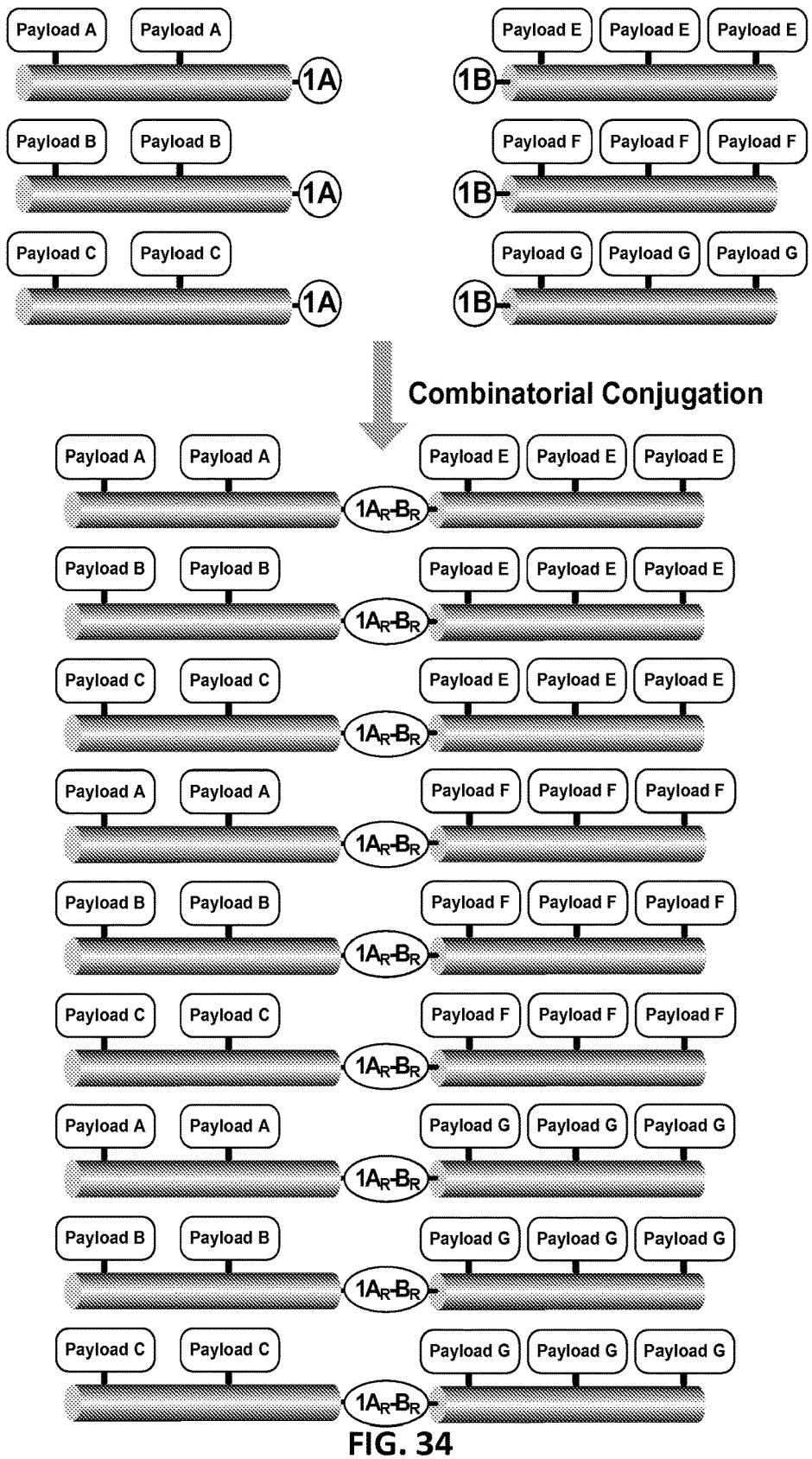
FIG. 34 shows an example of the creation of a combinatorial XTEN conjugate library. Payloads A, B, C are conjugated to XTEN carrying reactive group 1A, resulting in one set of XTEN-precursor segments. Payloads E, F, and G are conjugated to XTEN carrying reactive group 1B, resulting in a second set of XTEN-precursor segments. These segments are subjected to combinatorial conjugation and then are purified from reactants. This enables the formation of combinatorial products that can be immediately subjected to in vitro and in vivo testing. In this case, reactive groups 1A and 1B are the alpha-amino groups of XTEN with or without a bispecific cross-linker. In one example, the 1A is an azide and 1B is an alkyne or vice versa, while the payloads are attached to XTEN via thiol groups in XTEN.
Figure 35:
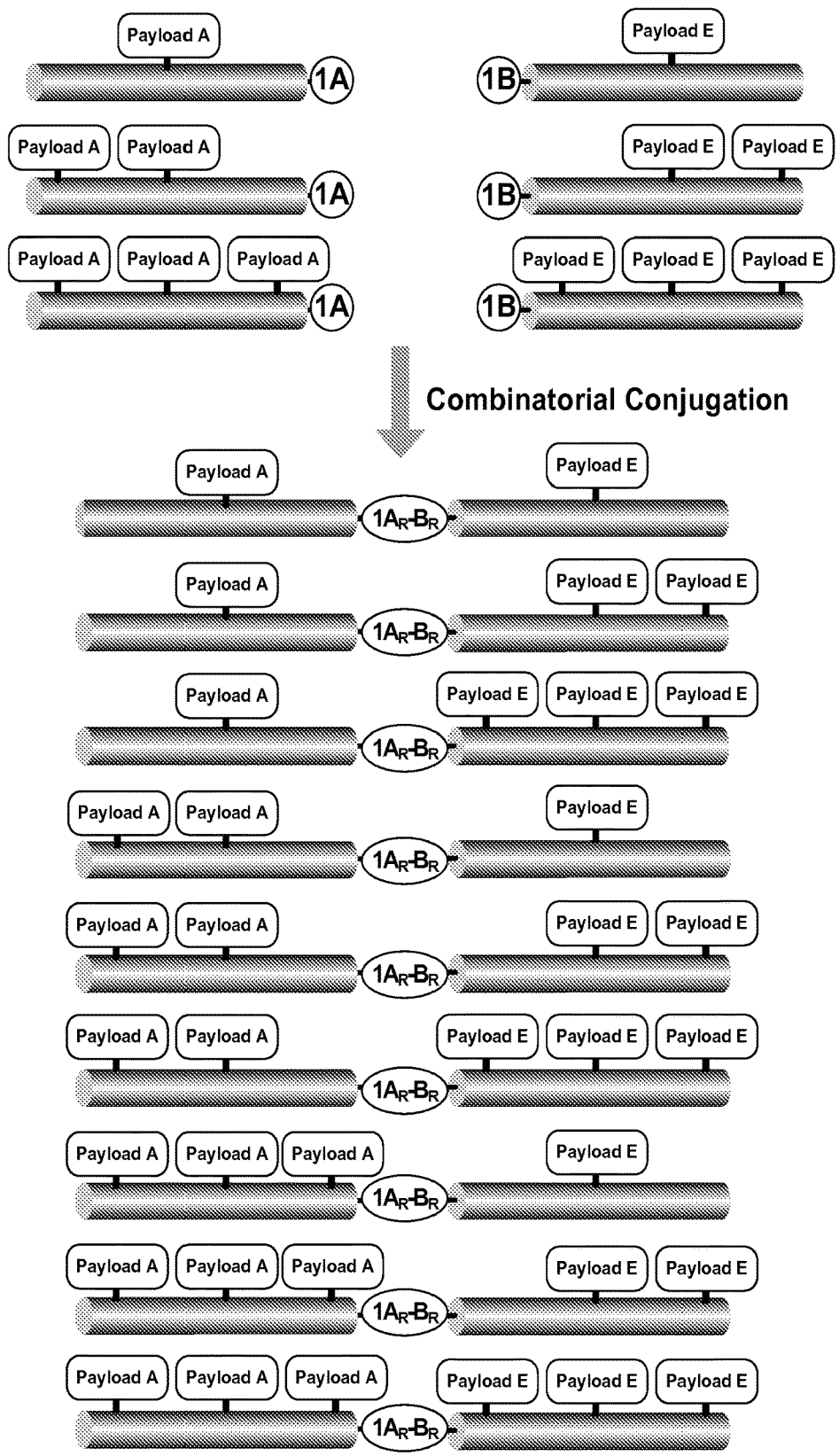
FIG. 35 shows an example of the creation of a combinatorial XTEN conjugate library that optimizes the ratio between two payloads. Each library member carries a different ratio of payload A and payload E.
Figure 36:
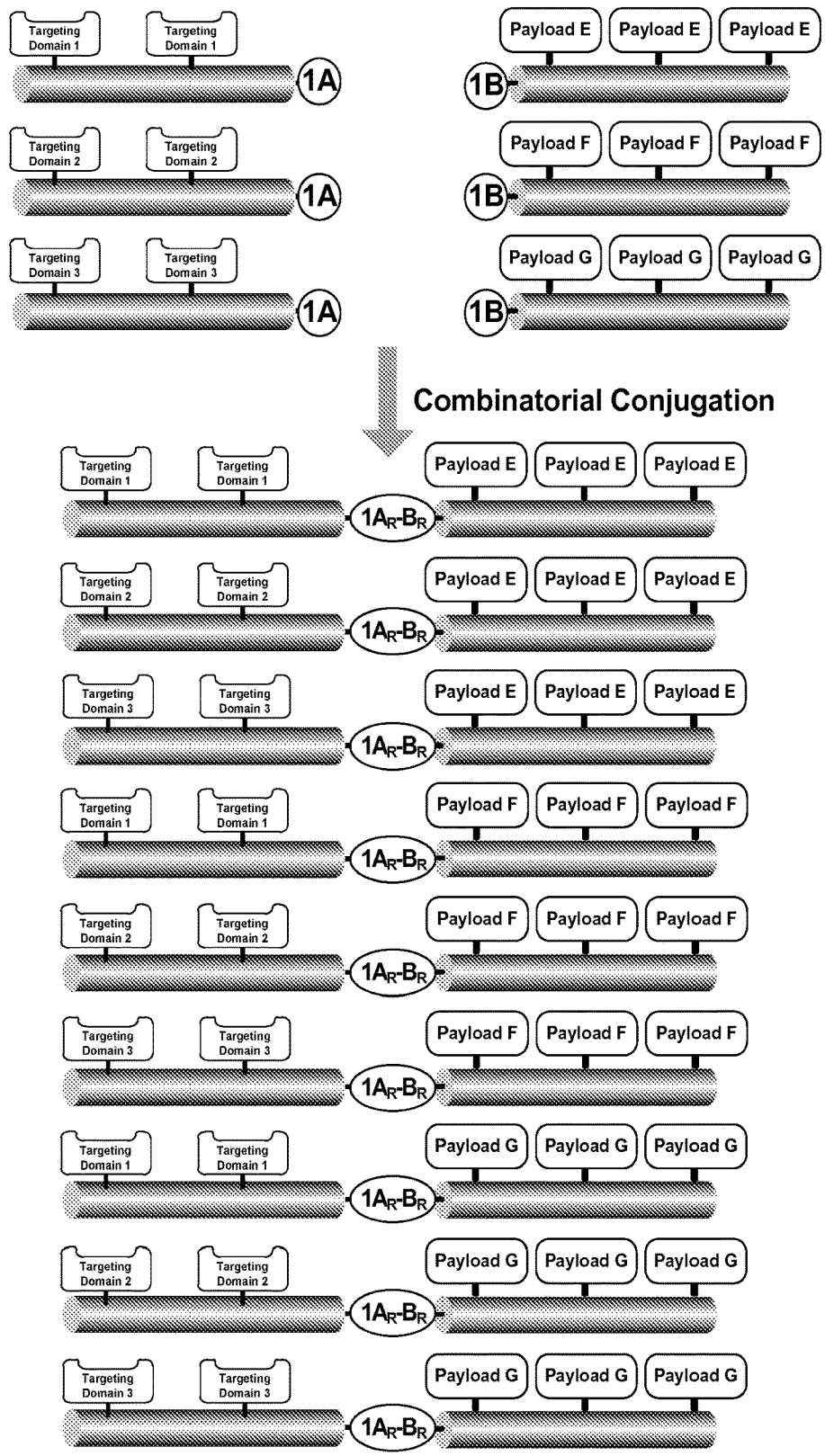
FIG. 36 shows an example of the creation of a combinatorial XTEN conjugate library that creates combinations of targeting moieties and payloads. The targeting moieties 1, 2, and 3 are conjugated to XTEN carrying reactive group 1A. Payloads E, F, and G are conjugated to XTEN carrying reactive group 1B. These segments are subjected to combinatorial conjugation, enabling the formation of combinatorial products where each library member comprises targeting moieties and payloads. All XTEN segments carrying payloads and conjugation groups can be purified as combinatorial products that can be immediately subjected to in vitro and in vivo testing.

In another aspect, the invention provides libraries of XTEN-payload precursors, methods to make the libraries, and methods to combine the library precursors in a combinatorial approach, as illustrated in FIGS. 34-35, to achieve optimal combinations of, as well as the optimal ratio of payloads. In one embodiment, the invention provides a library of individual XTEN each linked to 1, or 2, or 3, or 4, or 5, or 6, or 7, or 8, or 9, or 10 or more or more molecules of a given payload, including those described herein, to create the library of XTEN-payload precursors. In the method, a series of XTEN-payload precursors to be linked are further conjugated to a linker, and then is subsequently mixed and reacted with the other XTEN-payload precursors capable of reacting with the linker under conditions to effect the conjugation, resulting in a library of the various permutations and ratios of payloads linked to XTEN. Such a library is then screened in an in vitro or in vivo assay suitable to assess a parameter in a given clinical indication (e.g., cancer, metabolic disorder, diabetes) in order to determine those compositions providing the optimal response. In one exemplary embodiment, one category of payload precursor includes various targeting modules, such as peptides (e.g., the targeting moieties of Table 17) with binding affinity to a tumor-associated antigen of Table 20, and the second category of precursor is one or more drugs, such as a cytotoxic drug or a drug chosen from Table 9. Each category of precursor to be linked is further conjugated to a linker, and, as illustrated in FIG. 36, is subsequently mixed and reacted with the other XTEN-payload precursors capable of reacting with the linker under conditions to effect the conjugation, resulting in a library of the various targeting moieties and drug permutations in varying ratios to each other. The XTEN-payload conjugates are designed to permit fixed ratios of one payload to another; e.g., is 1:1, or 1:1.5, or 1:2, or 1:3, or 2:3, or 1:4, or 1:5 or 1:9 in the case of two different payloads. Similar ranges of ratios would be applied for library conjugates comprising 3, 4, 5 or more payloads.

In other embodiments, the libraries are constructed using three or more payloads known to have a beneficial effect in the treatment of a common disease. In one embodiment, a library comprises payloads linked to XTEN, wherein each payload is a drug or biologically effective for ameliorating a common disease. In another embodiment, a library comprises payloads linked to XTEN, wherein each drug or biologic is effective for treating different symptoms of a common disease. In another embodiment, a library comprises payloads linked to XTEN, wherein each drug or biologic mediates their therapeutic effect via a common biological pathway. In the foregoing embodiments of the libraries, the common disease is selected from cancer, cancer supportive care, cardiovascular, central nervous system, endocrine disease, gastrointestinal, genitourinary, hematological, HIV infection, hormonal system, inflammation, autoimmune disease, infectious diseases, metabolic disease, musculoskeletal disease, nephrology disorders, ophthalmologic diseases, pain, and respiratory. With greater particularity, the disease for which the libraries are constructed with payloads known to have a beneficial effect is selected from Table 16. Payloads suitable for use in the treatment or prevention of such diseases include those described herein (e.g., the payloads of Tables 11, 12, 18, and 21), or can be found in commonly accessible databases or would otherwise be known to those of ordinary skill in the art.

TABLE 16

Diseases for which Payloads are Indicated
Disease

Achondroplasia
Acromegaly
AIDS
Alzheimer's disease
Anemia
Arthritis
Asthma
Atherosclerosis
Autism
Autoimmune disease
Batten disease
Bone & cartilage repair
Cachexia
Cancer (all types)
Cardiovascular diseases
Chemotherapy-induced diseases
Chronic kidney disease-induced complication
Coagulation disorder
Colitis
Congenital hyperinsulinism
Congestive heart failure
COPD
Crohn's disease
Cystic fibrosis
Diabetes Diabetes-induced complication
Diabetic nephropathy
Diabetic neuropathy
Diagnostic
Eating disorder

TABLE 16-continued

Diseases for which Payloads are Indicated
Disease

Figure 37:
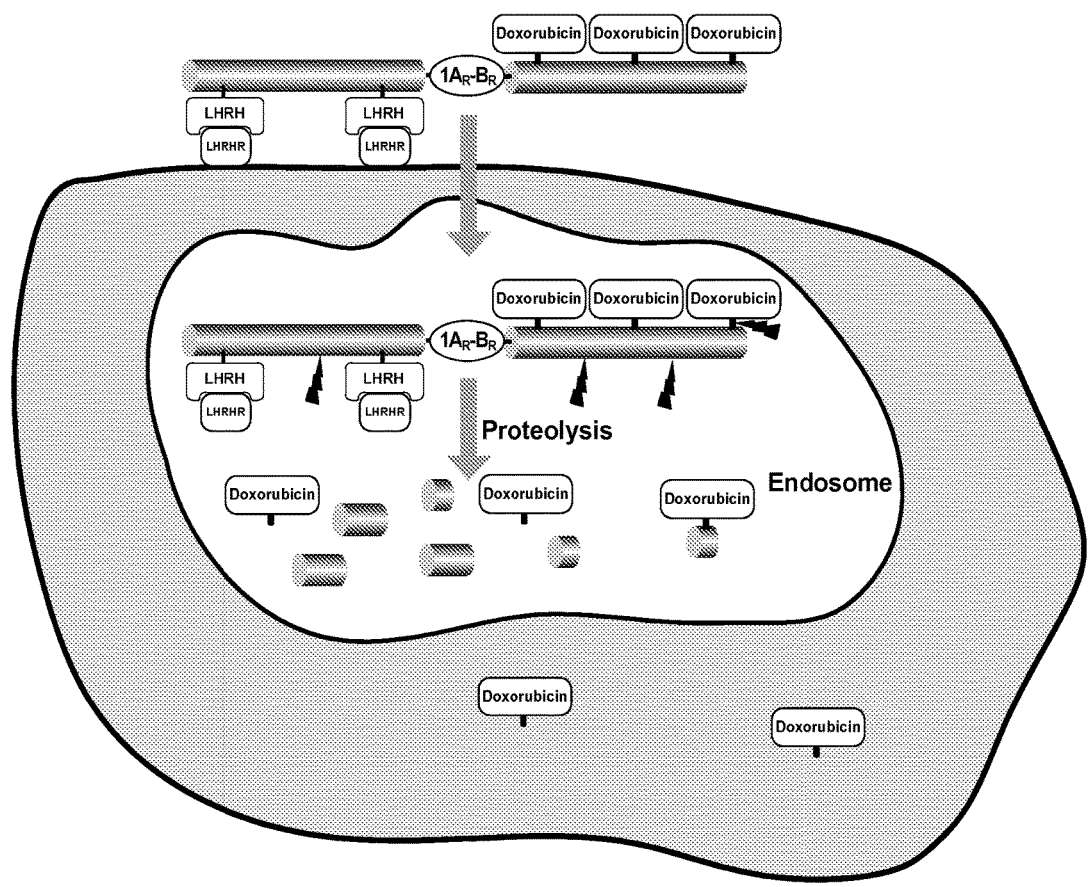
FIG. 37 shows an example of an XTEN conjugate comprising targeting moieties and payloads that exert selective action on the surface of a target cell, such as a tumor cell. The particular design of the dimeric XTEN conjugate comprises LHRH and doxorubicin. This conjugate binds to the LHRH-receptor on that is over-expressed on many cancer cells. Receptor binding results in internalization followed by proteolytic break down and the intracellular liberation of doxorubicin, which is toxic to the cell.

Erythropoietic protoporphyria
Gastrointestinal disorder
Gout
Growth hormone deficiency
Hemophilia
Hepatitis B
Hepatitis C
Hereditary emphysema
HIV
Hyperlipidemia/Dyslipidemia
Hyperparathyroidism
Hypertension
Hypoglycemia
Hypoparathyroidism
Hypothyroidism
Infectious diseases
Infertility
Inflammatory diseases
Lipodystrophy
Lymphopenia
Macular degeneration Metabolic conditions
Mucositis
Multiple sclerosis
Muscular dystrophy
Musculoskeletal
Myocardial infarction/ischemia
Neutropenia
Obesity
Osteoarthritis
Osteoporosis
Pain
Parkinsons disease
Paroxysmal nocturnal hemoglobinuria
Phenylketonuria
Psoriasis
Pulmonary arterial hypertension
Pulmonary hypertension
Radiotherapy-induced diseases
Sepsis
Sexual dysfunction
Short bowel syndrome
Stroke
Thrombocytopenia
Thyroid disease
Transplantation
Viral infection In one embodiment, as illustrated in FIG. 37, the bispecific conjugate has a drug module linked to the XTEN by a cleavable or labile linker, wherein the linker can be cleaved or disassociates after administration to a subject, including upon intracellular internalization in a cell targeted by the targeting modules. In another embodiment the drug is linked to XTEN by an non-cleavable linker but the conjugate remains susceptible to degradation. Upon internalization the XTEN is cleaved by proteases and the drug connected to its linker is liberated resulting in cytotoxicity.

In one exemplary embodiment, the targeting module is luteinizing hormone-releasing hormone (aka LHRH, GnRH, and gonadotropin-releasing hormone), the drug is doxorubicin, wherein the ratio of LHRH to doxorubicin is 1:1, or 1:1.5, or 1:2, or 1:3, or 1:9, or 2:3, or 3:1, or 3:2, or 2:1, or 1.5:1. The conjugate can be generated starting from XTEN precursors. One XTEN precursor can carry 1, 2, or more drug molecules and a reactive cross-linker or click chemistry reactant or a reactive amino acid. A second XEN precursor carries 1, 2, or more LHRH domains for targeting and a reactive cross-linker or click chemistry reactant or a reactive amino acid. Both precursor segments are then joined by reaction between reactive groups of the respective XTEN. In one exemplary embodiment the reactive group is an azide that is conjugated to the N-terminus of first XTEN segment via a cross-linker, and reactive group of the second XTEN is an alkyne that is conjugated to the N-terminus of the second XTEN segment via a cross-linker. In another embodiment of the LHRH-XTEN-drug conjugate, the drug is maytansin. In another embodiment of the LHRH-XTEN-drug conjugate the drug is auristatin.

8. Conjugates of XTEN-Payload Linked to Targeting Moieties

In another aspect, the present invention provides conjugate compositions comprising one or more XTEN-payload compositions linked to targeting moieties. The subject targeted compositions find use in the treatment of a variety of conditions where selective delivery of a therapeutic or toxic payload to a cell, tissue or organ is desired. The invention contemplates a diversity of targeting moieties for use in the subject compositions, including antibodies, antibody fragments, and antibody mimetics including, but not limited to those set forth in Table 17, as well as peptides and small molecules capable of binding ligands or receptors associated with disease or metabolic or physiologic abnormalities. In one embodiment, the invention provides a conjugate comprising at least one targeting moiety from Tables 17, 18 or 21 linked to at least one XTEN. In another embodiment, the invention provides a conjugate comprising at least one targeting moiety from Tables 17, 18 or 21 linked to each of at least two, or three, or four XTEN. In another embodiment, the invention provides a conjugate comprising at least one targeting moiety from Tables 17, 18 or 21 linked to at least one XTEN and at least one drug or biologic payload selected from the group consisting of the payloads set forth in Table 11, Table 12, Table 18, or Table 21 linked to the at least one XTEN. In one embodiment, the invention provides targeting moiety-XTEN-drug conjugate compositions wherein the composition is selectively delivered to a ligand or receptor on a targeted cell, which can then be internalized into the cell, as illustrated in FIG. 37, resulting in a pharmacologic effect know in the art for the drug component.

As illustrated in FIGS. 21-24, and 28-32, such conjugate compositions can have different valencies, with one, two, three, or four or more XTEN-payload molecules linked to one or more targeting antibody or targeting moiety. In the case of antibody targeting moieties, in one embodiment the XTEN-payload is linked by a cross-linker to a cysteine in a hinge region of the antibody. In another embodiment, the XTEN-payload is linked by a disulfide bridge to a cysteine in a hinge region of the antibody. Accordingly, an antibody-XTEN-payload conjugate can comprise 1, 2, 3, or 4 or more XTEN-payload segments linked to the antibody, antibody fragment or mimetic. In another embodiment XTEN is conjugated outside of the hinge region, which includes inserting cysteine in the antibody to control conjugation sites or by conjugation to existing lysine side chains. The linking of XTEN-payload to create the antibody conjugates has many benefits: a) the XTEN payload serves as a cleavable linker, b) it provides solubility, c) it allows setting the ratio of drugload per IgG, and d) it can be pre-conjugated with drug to simplify manufacturing.

TABLE 17

Figure 28:
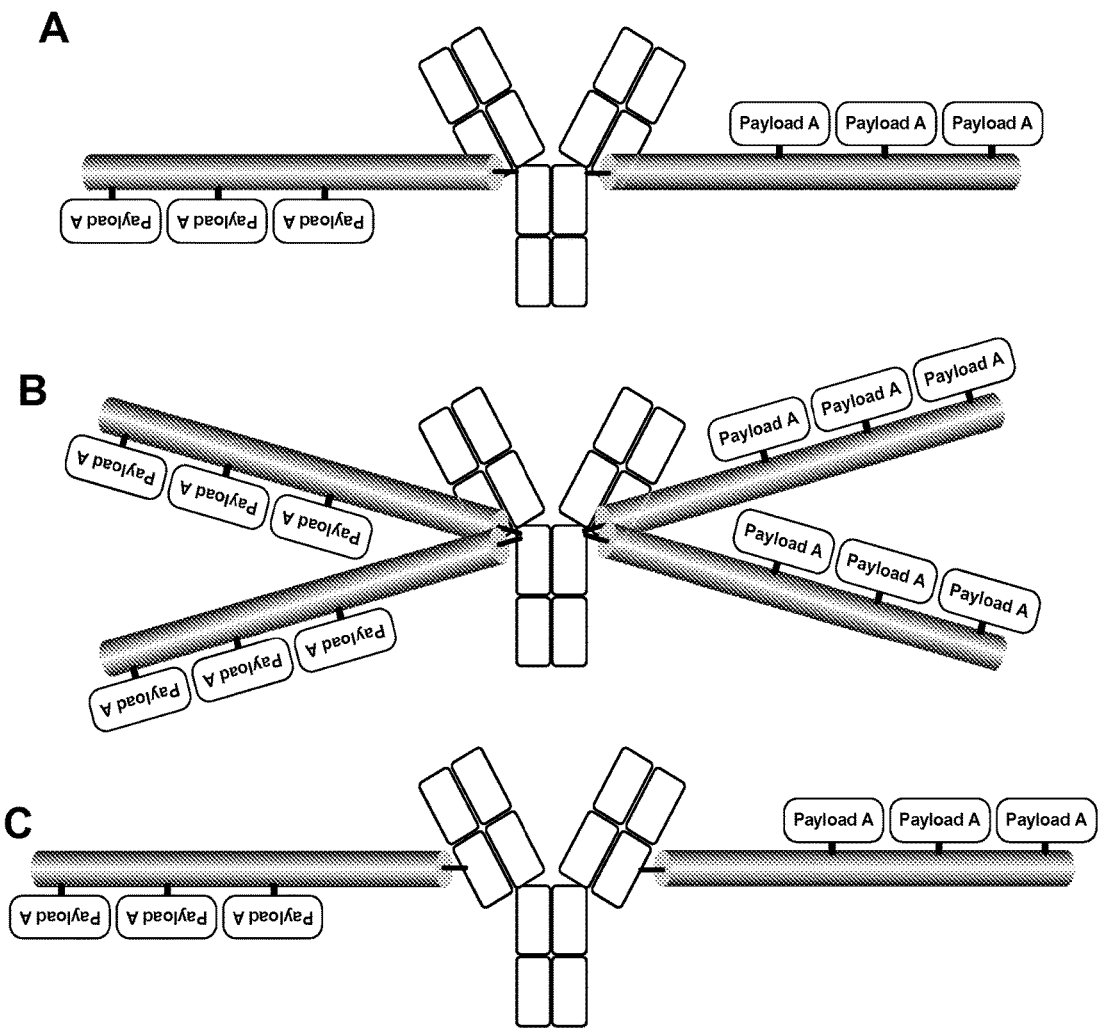
FIG. 28 shows examples of multivalent conjugates combining an antibody, XTEN, and a payload. Such constructs can have different valencies and provide many benefits in that the XTEN can have a cleavable linker, XTEN can provides solubility to the composition, and it can allow adjustment of the drug load per IgG, and the XTEN can be pre-conjugated with drug to simplify manufacturing.
Figure 29:
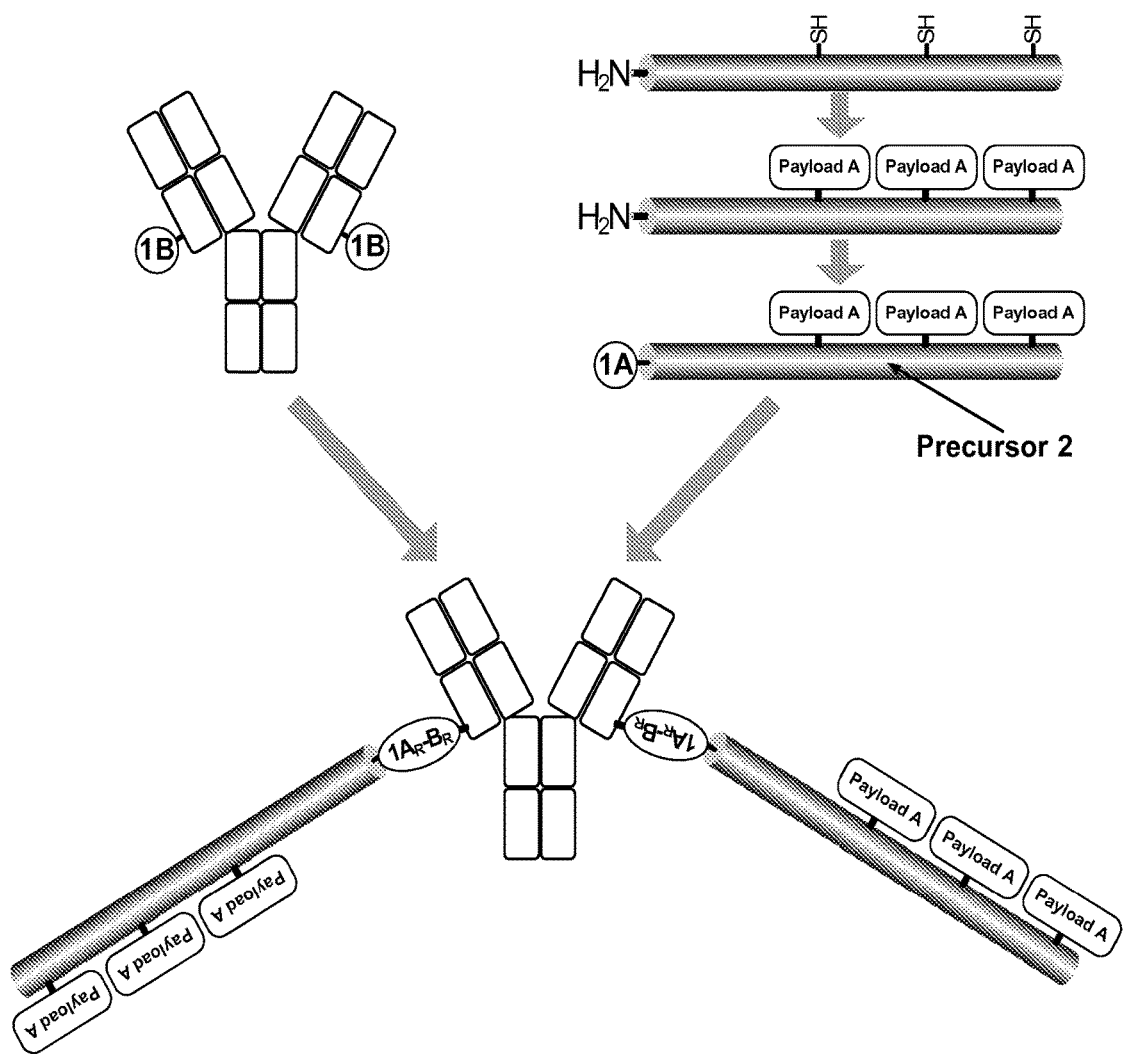
FIG. 29 shows examples of the construction of conjugates combining an antibody, XTEN, and a payload. The antibody can have one or multiple reactive groups 1B. XTEN can be conjugated to one or multiple Payloads A. In addition XTEN can carry a reactive group 1A that preferentially reacts with the reactive group 1B on the antibody. The location of reactive groups 1B in the antibody controls the number and location of XTENs that are conjugated to the antibody, resulting in the final product.
Figure 30:
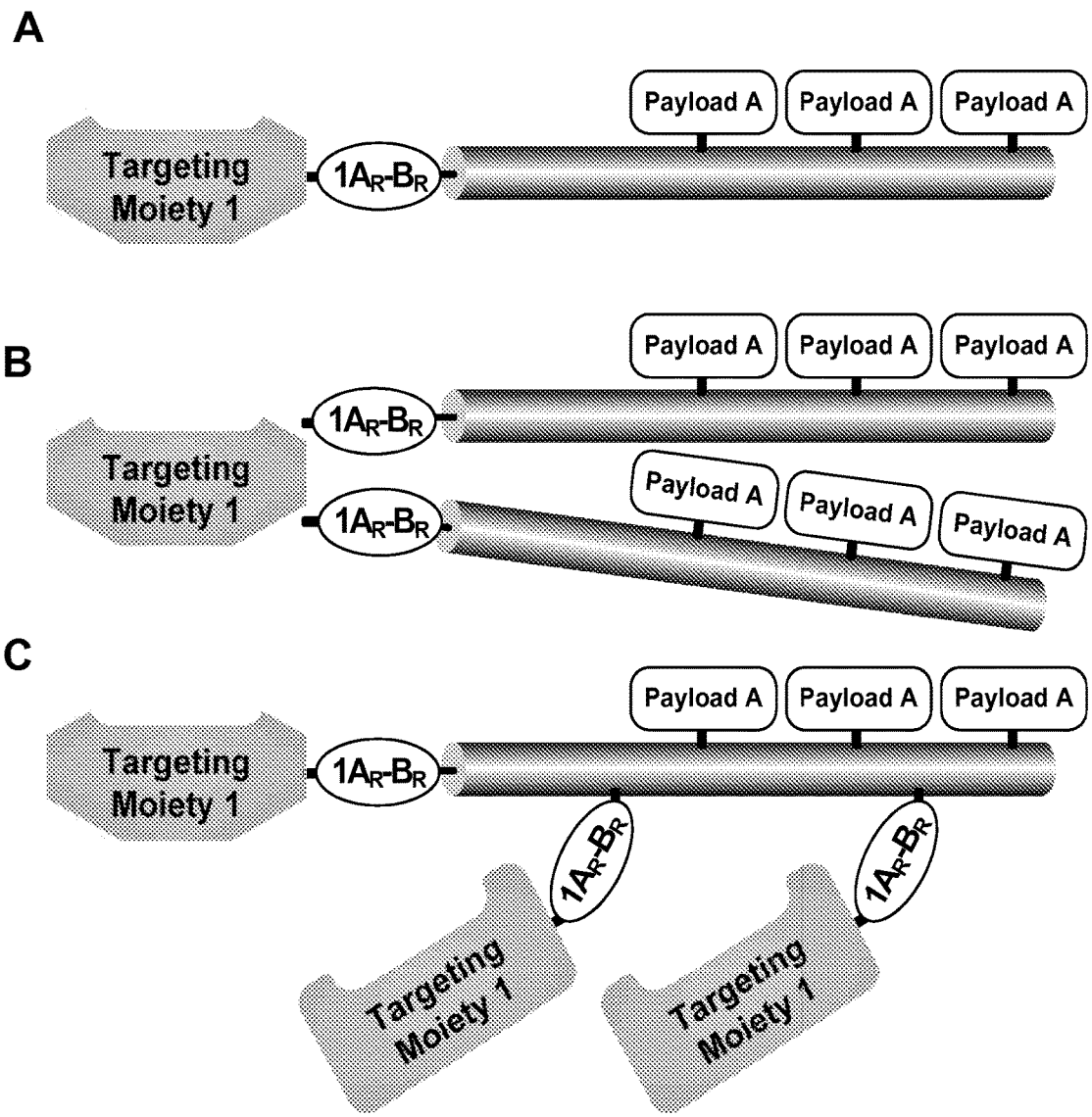
FIG. 30 shows examples of conjugates comprising a targeting moiety, XTEN, and a payload. Targeting moieties can be peptides, peptoids, or receptor ligands.
Figure 31:
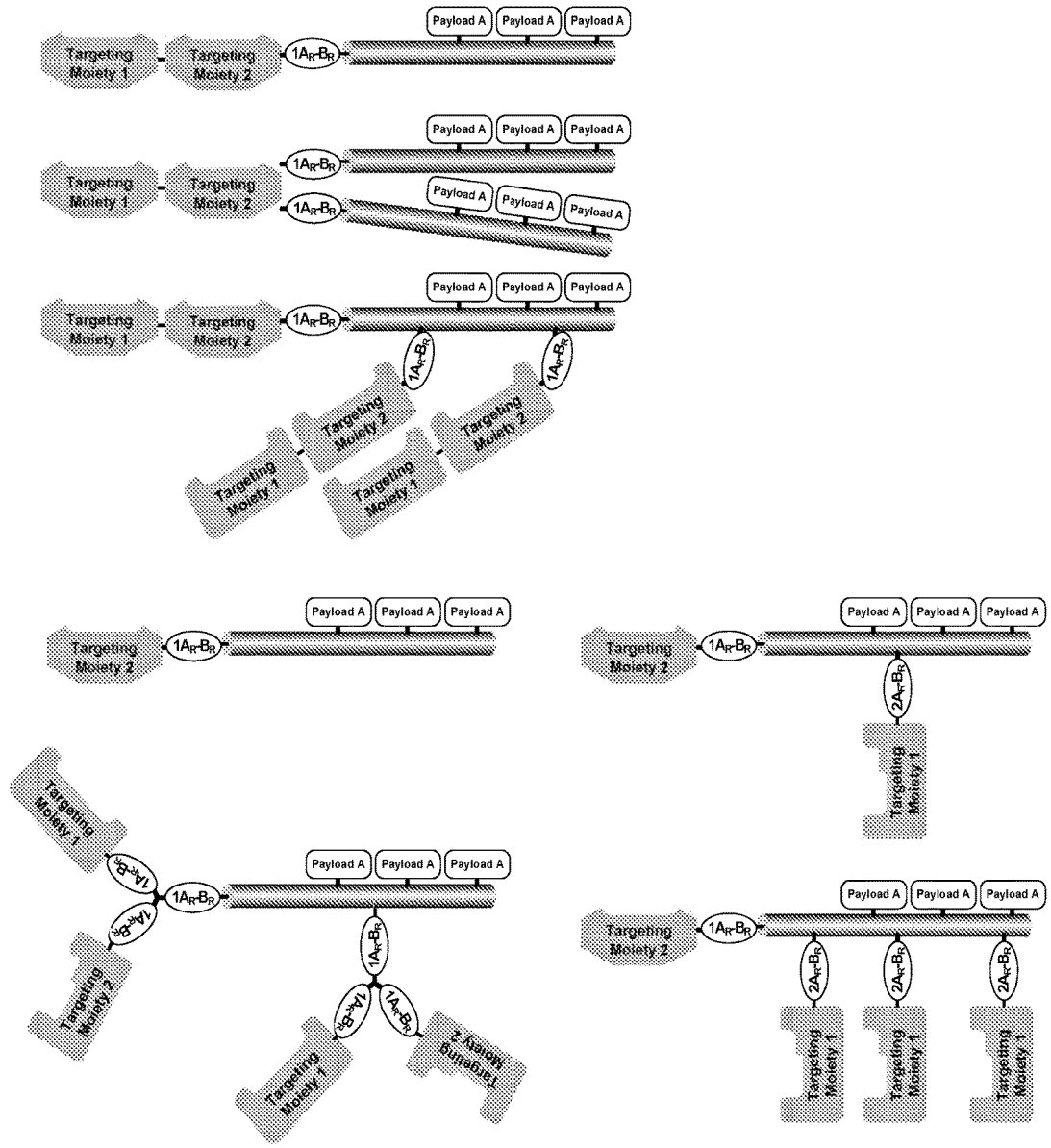
FIG. 31 shows examples of conjugates comprising multiple different targeting moieties, XTEN, and a payload. Targeting moieties can be peptides, peptoids, receptor ligands.
Figure 32:
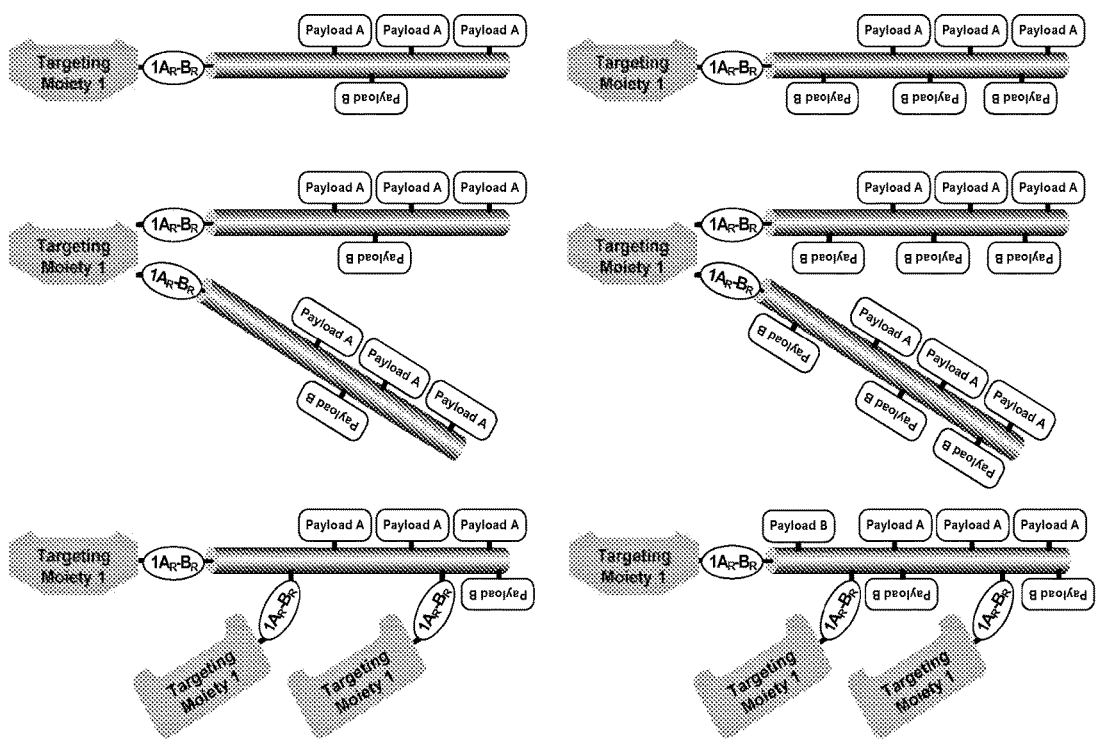
FIG. 32 shows examples of conjugates comprising a targeting moiety, XTEN, and a multiple different payloads.
Figure 33:
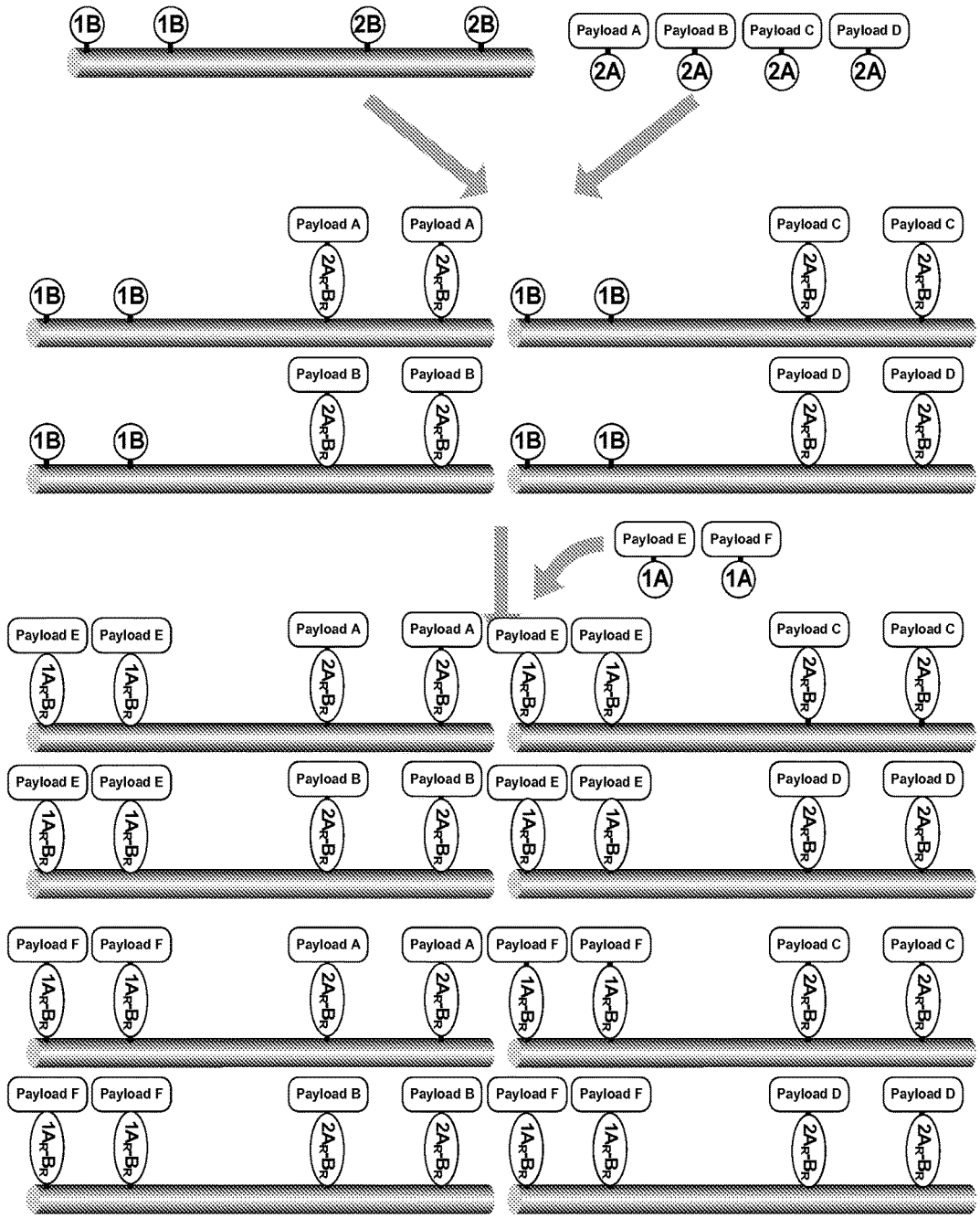
FIG. 33 shows examples of combinatorial XTEN conjugates. Payloads A, B, C, and D carry a reactive group 2A that reacts with reactive group 2B on the XTEN precursor. In the next step, Payloads E and F carry a reactive group 1A that reacts with reactive group 1B on XTEN, resulting in a library of different permutations of bispecific conjugates. In this case, the reactive groups 1B and 2B are thiol- and amino-groups, respectively.

Targeting Moieties: Antibody fragments, scaffolds and mimetics
Targeting Moieties ABDURINS
AdNectins/Fibronectin type III domain
Adnexins/Fibronectin TABLE 17-continued Targeting Moieties: Antibody fragments, scaffolds and mimetics
Targeting Moieties Affibodies/Protein Z
Affilins
AFFINILUTE
AFFINIMIP
AFIM
Anticalins/Lipocalins
Aptabody
Aptamers
Armadillo repeat proteins
Avimers
Azymetric
Bispecific diabodies
BiTEs
Bivalent diabodies
Centyrins
DARPins/Ankyrin repeat proteins
Diabodies
Domain antibodies/dAbs/human Vh
Engineered affinity proteins
Evibodies
Fabs
Fv
Fynomers
Glubody
Im7/ColE7 immunity protein
iMabs
Knottin/Cysteine-knot miniproteins
Kunitz domains
Maxibodies
Microbodies
Minibodies
Molecular imprinted polymers (MIPs)
Monobodies
Monoclonal T cell receptors (mTCR)
MonoLex
Nanobodies
Nanofitins
Phylomers
Shark Vhh
SMIPs
SOMAmers
Stable scFV
Spiegelmers
Synbodies
TandAbs ®
Telobodies
Tetrabodies
Tetranectins TABLE 17-continued Targeting Moieties: Antibody fragments, scaffolds and mimetics
Targeting Moieties Tetravalent bispecific antibodies
Trans-body
Triabodies In some embodiments, the invention provides conjugates comprising a targeting component as one payload and a toxin as a second payload, with one or more copies of each payload type linked to the XTEN of the composition. In a variation of the foregoing, the conjugate can optionally have the toxin linked to the XTEN with a labile or a cleavable linker such that the toxin is liberated when delivered to or is internalized within the target. In another variation of the foregoing, the targeting component is an antibody or antibody fragment, with one, two, three, or four XTEN-payload compositions conjugated with linkers to the antibody (e.g., conjugated to cysteines in the hinge region as illustrated in FIGS. 28-29), providing conjugates for use in targeted therapy of clinical indications such as, but not limited to, various treatment of tumors and other cancers wherein the antibody provides the targeting component and the XTEN-payload effects the intended activity (e.g, cytotoxicity in a tumor cell). Hence, the inventive conjugates are a type of immunoconjugate. The targeted conjugates can be designed with targeting components that are derived from antibodies, or antibody mimetics, or are peptides or small molecules that bind ligands associated with diseases cells or organs. Non-limiting examples of categories of antibody fragments, scaffolds and mimetics are provided in Table 17. Non-limited examples of specific targeting components, the targets to which they are directed, and toxins that may be utilized as payloads in the inventive conjugates are provided in Table 18. It is specifically contemplated that the targeted conjugate compositions of the present disclosure include compositions of any given targeting component that can be used in combination with one or more of any of the toxins of Table 18 or the payloads provided in Table 11 or Table 12. It is further contemplated that an XTEN-payload conjugate can comprise two or more targeting components, which may be identical or may be different. It is contemplated that such conjugates can be used in treatment of conditions such as, but not limited to those set forth in Table 15.

TABLE 18

Exemplary targeting moieties, toxin payloads, and targets to which conjugate compositions can be directed

| Class | Target | Targeting Moiety | Toxin |
|---|---|---|---|
| Peptide | LHRHR | LHRH & analogues (e.g. D-Lys-(6)-LHRH) | doxorubicin |
| | CD13, Aminopeptidase | NGR class (e.g. CNGRC (SEQ ID NO: 581), CNGRCG (SEQ ID NO: 582), GNGRG (SEQ ID NO: 583), KNGRE (SEQ ID NO: 584), (GNGRG)2KGK (SEQ ID NO: 585), CVLNGRMEC (SEQ ID NO: 586), NGRAHA (SEQ ID NO: 587), CNGRCVSGCAGRC (SEQ ID NO: 588)) | paclitaxel auristatin (e.g. monomethyl auristatin E; monomethyl auristatin F) maytansine (e.g. maytansinoid DM1; maytansinoid DM4) dolastatin |
| | Folate receptor | Folate & analogue (e.g. γ-folate, α-folate; pteroate-gly) | calicheamicin vinca alkaloid (e.g. |
| | Integrin | Cilengitide; RGD-4C; iRGD | desacetylvinblastine |
| | LRP receptor | Angiopep-2 | monohydrazide) |

TABLE 18-continued

Exemplary targeting moieties, toxin payloads, and targets to which conjugate compositions can be directed

| Class | Target | Targeting Moiety | Toxin |
|---|---|---|---|
| | Somatostatin receptor | Somatostatin & analogues (e.g. octreotide; pasireotide; lanreotide; vapreotide, JF-07-69) | camptothecin mitomycin C epothilone |
| | Nucleolin | F3 peptide | hTNF |
| | PDGFR-beta | RGR | IL-12 |
| | LyP-1 receptor | LyP-1; CGNKRTRGC (SEQ ID NO: 589) | Bortezomib Ranpirnase |
| | Chondroitin sulfate proteoglygan NG2 | TAASGVRSMH (SEQ ID NO: 590); LTLRWVGLMS (SEQ ID NO: 591) | pseudomonas exotoxin SN-38 |
| | VPAC1 and VPAC2 | Vasoactive intestinal peptide | Rachelmycin |
| | CCK1 and CCK2 | Cholecystokinin | m-TOR inhibitor |
| | Gastrin receptor, CCK1 & CCK2 | Gastrin | rapamycin tubulysin (tubulysin |
| | GRP receptor subtype | Gastrin-releasing peptide | B; tubulysin M) |
| | Neurotensin receptor | Neurotensin | duocarmycin |
| | Alpha-MSH receptor | Alpha-melanocyte stimulating hormone | |
| | Oxytocin receptor | Oxytocin | |
| | Lymphatic vessels | LyP-2; CNRRTKAGC (SEQ ID NO: 592) | |
| | Lymphatic vessels | LSD; CLSDGKRKC (SEQ ID NO: 593) | |
| | Lymphatic vessels | REA; CREAGRKAC (SEQ ID NO: 594) | |
| | Lymphatic vessels | AGR, CAGRRSAYC (SEQ ID NO: 595) | |
| | Pericytes & endothelia cells | RSR; CRSRKG (SEQ ID NO: 596) | |
| | Pericytes & endothelia cells | KAA; CKAAKNK (SEQ ID NO: 597) | |
| | Blood vessels | CSRPRRSEC (SEQ ID NO: 598) | |
| | Angiogenic blood vessels & tumor cells | KRK; CGKRK (SEQ ID NO: 599) | |
| | Angiogenic blood vessels | CDTRL (SEQ ID NO: 600) | |
| | Angiogenic blood vessels & tumor cells | CGTKRKC (SEQ ID NO: 601) | |
| Protein | DR4, DR5 | TRAIL | |
| Antibody-like scaffold | Various | DARPINS | |
| | Various | Centyrins | |
| Antibody | Lewis-Y-related antigen | Br96; anti-Lewis-Y-related antigen antibody | |
| | HER2 | Trastuzumab; Pertuzumab; anti-HER2 antibody | |
| | EGFR | Cetuximab; anti-EGFR antibody | |
| | Nectin-4 | anti-nectin-4 antibody | |
| | CanAg (mucin-type glycoprotein) | huC242, anti-CanAg antibody | |
| | CD138 | anti-CD138 antibody | |
| | CD19 | MDX-1342; MOR-208; HuB4; anti-CD19 antibody | |
| | CD22 | Epratuzumab; Bectumomab; Inotuzumab; Moxetumomab, RFB4; anti-CD22 antibody | |
| | CD23 | Lumiliximab, anti-CD23 antibody | |
| | CD25 (IL-2 receptor) | Daclizumab, anti-CD25 antibody | |
| | CD30 | Xmab2513; cAC10; MDX-060; anti-CD30 antibody | |
| | CD33 | Gemtuzumab; HuM195; huMy9-6; anti-CD33 antibody | |
| | CD38 | Daratumumab, anti-CD38 antibody | |
| | CD40 | SGN-40; HCD122; anti-CD40 antibody | |
| | CD56 | huN901; anti-CD56 antibody | |
| | CD70 | MDX-1411; anti-CD70 antibody | |
| | CD74 | Milatuzumab; anti-CD74 antibody | |
| | CD79b | anti-CD79b antibody | |
| | CD80 | Galiximab; anti-CD80 antibody | |

TABLE 18-continued

Exemplary targeting moieties, toxin payloads, and targets to which conjugate compositions can be directed

| Class | Target | Targeting Moiety | Toxin |
|---|---|---|---|
| | Carcinoembryonic antigen (CEA) | Lapetuzumab, hCOL-1anti-CEA antibody | |
| | Cripto | anti-Cripto antibody | |
| | cMET | CE-355621, DN30, MetMAb; antagonist anti-cMET antibody | |
| | EpCAM | Adecatumumab; Edrecolomab; Catumaxomab; anti-EpCAM antibody | |
| | EphA2 | 1C1, anti-EphA2 antibody | |
| | GPNMB (human gylcoprotein NMB (osteoactivin)) | glembatumumab, anti-GPNMB antibody | |
| | Integrins | anti-integrin antibody | |
| | MUC-1 (epitope CA6) | anti-MUC-1 antibody | |
| | PSMA | MDX-070, MLN591, anti-PSMA antibody | |
| | TGFa | anti-TGFa antibody | |
| | TIM1 | anti-TIM1 antibody | |
| | Folate receptor 1 | M9346A, Farletuzumab, anti-folate receptor antibody | |
| | IL-13 receptor | anti-IL-13 receptor antibody | |

In particular embodiments, the invention provides XTEN-payload conjugates comprising one or more LHRH targeting components selected from Table 19 and one or more drug components selected from Table 11. In the foregoing embodiment, the LHRH can be linked to one XTEN segment that, in turn, is linked to one or more XTEN segments to which the drug components are conjugated. Alternatively, the LHRH and drug components can be conjugated to a monomeric XTEN. Further, the drug components can optionally be linked to XTEN using labile or cleavable linkers that permit the drug to be liberated from the conjugate after administration to a subject.

TABLE 19

Exemplary LHRH

| Composition | SEQ ID NO: |
|---|---|
| pGlu-HWSYGLRPG-NH2 | 602 |
| pGlu-HWSY[D-Lys]LRPG-NH2 | 603 |
| pGlu-HWSY[D-Trp]LRPG-NH2 | 604 |

TABLE 19-continued

Exemplary LHRH

| Composition | SEQ ID NO: |
|---|---|
| pGlu-HWSY[D-Leu]LRP-NHEt | 605 |
| pGlu-HWSY[D-Ser(tBu)]LRP-NHEt | 606 |
| pGlu-HWSY[D-2-Nal]LRPG-NH2 | 607 |
| pGlu-HWSY[D-His(Bzl)]LRP-NHEt | 608 |
| pGlu-HWSY[D-Ser(tBu)]LRP-Azagly-NH2 | 609 |
| pGlu-HWSY[D-Trp]LRP-NHEt | 610 |
| pGlu-HWSHDWLPG-NH2 | 610 |

Additional targets contemplated for which the XTEN-payload conjugates can be directed include tumor-associated antigens listed in Table 20. In one embodiment, the invention provides XTEN-payload conjugates comprising one or more targeting components capable of binding one or more targets of Table 20.

TABLE 20

Tumor-associated antigen targets

| TAA targets (synonyms) | Accession Number and References |
|---|---|
| Her2 (ErbB2) | GenBank accession no. M11730; U.S. Pat. No. 5,869,445; WO2004048938; WO2004027049; WO2004009622; WO2003081210; WO2003089904; WO2003016475; US2003118592; WO2003008537; WO2003055439; WO2003025228; WO200222636; WO200212341; WO200213847; WO200214503; WO200153463; WO200141787; WO200044899; WO200020579; WO9630514; EP1439393; WO2004043361; WO2004022709; WO200100244 |
| BMPR1B (bone morphogenetic protein receptor-type IB) | GenBank accession no. NM_001203; WO2004063362; WO2003042661; US 2003134790; WO2002102235; WO2003055443; WO200299122; WO2003029421; WO2003024392; WO200298358' WO200254940; WO200259377; WO200230268 |

TABLE 20-continued

Tumor-associated antigen targets

| TAA targets (synonyms) | Accession Number and References |
|---|---|
| E16 (LAT1, SLC7A5) | GenBank accession no. NM_003486); WO2004048938; WO2004032842; WO2003042661; WO2003016475; WO200278524; WO200299074; WO200286443; WO2003003906; WO200264798; WO200014228; US2003224454; WO2003025138 |
| STEAP1 (six transmembrane epithelial antigen of prostate) | GenBank accession no. NM_012449; WO2004065577; WO2004027049; EP1394274; WO2004016225; WO2003042661; US2003157089; US2003185830; US2003064397; WO200289747618; WO2003022995 |
| STEAP2 (six transmembrane epithelial antigen of prostate 2) | GenBank accession no. AF455138; WO2003087306; US2003064397; WO200272596; WO200172962; WO2003104270; WO2003104270; US2004005598; WO2003042661; US2003060612; WO200226822; WO200216429 |
| CA125/0772P (MUC16) | GenBank accession no. AF361486; WO2004045553; WO200292836; WO200283866; US2003124140 |
| megakaryocyte potentiating factor (MPF, mesothelin) | GenBank accession no. NM_005823; WO2003101283; WO2002102235; WO2002101075; WO200271928; WO9410312 |
| Na/Pi cotransporter type IIb (NaPi3b) | GenBank accession no. NM_006424; WO2004022778; EP1394274; WO2002102235; EP875569; WO200157188; WO2004032842; WO200175177 |
| Semaphorin 5b (SEMA5B, SEMAG) | GenBank accession no. AB040878; WO2004000997; WO2003003984; WO200206339; WO200188133; WO2003054152; WO2003101400 |
| Prostate cancer stem cell antigen (PSCA hlg) | GenBank accession no. AY358628; US2003129192; US2004044180; US2004044179; US2003096961; US2003232056; WO2003105758; US2003206918; EP1347046; WO2003025148 |
| ETBR (Endothelin type B receptor) | GenBank accession no. AY275463; WO2004045516; WO2004048938; WO2004040000; WO2003087768; WO2003016475; WO2003016475; WO200261087; WO2003016494; WO2003025138; WO200198351; EP522868; WO200177172; US2003109676; U.S. Pat. No. 6,518,404; U.S. Pat. No. 5,773,223; WO2004001004 |
| TRPV4 (Transient receptor potential cation channel, subfamily V) | US Pat App No. 20090208514 |
| CDC45L | GenBank Accession NO. AJ223728; US Pat App No. 20090208514 |
| CRIPTO (CR, CR1, CRGF) | GenBank accession no. NP_003203 or NM_003212; US2003224411; WO2003083041; WO2003034984; WO200288170; WO2003024392; WO200216413; WO200222808; U.S. Pat. No. 5,854,399; U.S. Pat. No. 5,792,616 |
| CD21 (CR2 (Complement receptor 2) or C3DR (C3d/Epstein Barr virus receptor) | GenBank accession no. M26004; WO2004045520; US2004005538; WO2003062401; WO2004045520; WO9102536; WO2004020595 |
| CD79b (CD79B, CD79β, IGb (immunoglobulin-associated beta), B29) | GenBank accession no. NM_000626 or 11038674; WO2004016225; WO2003087768; US2004101874; WO2003062401; WO200278524; US2002150573; U.S. Pat. No. 5,644,033; WO2003048202; WO 99/558658, U.S. Pat. No. 6,534,482; WO200055351 |
| FcRH2 (IFGP4, IRTA4, SPAP1A (SH2 domain containing phosphatase anchor protein 1a), SPAP1B, SPAP1C) | GenBank accession no. NM_030764, AY358130; WO2004016225; WO2003077836; WO200138490; WO2003097803; WO2003089624 |
| NCA (CEACAM6) | GenBank accession no. M18728; WO2004063709; EP1439393; WO2004044178; WO2004031238; WO2003042661; WO200278524; WO200286443; WO200260317 |
| MDP (DPEP1) | GenBank accession no. BC017023; WO2003016475; WO200264798 |
| IL20Rα (IL20Ra, ZCYTOR7) | GenBank accession no. AF184971; EP1394274; US2004005320; WO2003029262; WO2003002717; WO200222153; US2002042366; WO200146261; WO200146232; WO9837193 |
| BECAN (Brevican core protein) | GenBank accession no. AF229053; US2003186372; US2003186373; US2003119131; US2003119122; US2003119126; US2003119121; US2003119129; US2003119130; US2003119128; US2003119125; WO2003016475; WO200202634 |
| EphB2R (DRT, ERK, Hek5, EPHT3, Tyro5) | GenBank accession no. NM_004442; WO2003042661; WO200053216; WO2004065576 (Claim 1); WO2004020583; WO2003004529; WO200053216 |

TABLE 20-continued

Tumor-associated antigen targets

| TAA targets (synonyms) | Accession Number and References |
|---|---|
| B7h (ASLG659) | GenBank accession no. AX092328; US20040101899; WO2003104399; WO2004000221; US2003165504; US2003124140; US2003065143; WO2002102235; US2003091580; WO200210187; WO200194641; WO200202624; US2002034749; WO200206317; WO200271928; WO200202587; WO200140269; WO200036107; WO2004053079; WO2003004989; WO200271928 |
| PSCA (Prostate stem cell antigen precursor | GenBank accession no. AJ297436; WO2004022709; EP1394274; US2004018553; WO2003008537 (Claim 1); WO200281646; WO2003003906; WO200140309; US2001055751; WO200032752; WO9851805; WO9851824; WO9840403 |
| BAFF-R (B cell-activating factor receptor, BLyS receptor 3, BR3) | GenBank accession No. AF116456; WO2004058309; WO2004011611; WO2003045422; WO2003014294; WO2003035846; WO200294852; WO200238766; WO200224909 |
| CD22 (B-cell receptor CD22-β-form, BL-CAM, Lyb-8, Lyb8, SIGLEC-2, FLJ22814) | GenBank accession No. AK026467; WO2003072036 |
| CD79a (immunoglobulin-associated alpha) | GenBank accession No. NP_001774.10; WO2003088808, US20030228319; WO2003062401; US2002150573; WO9958658; WO9207574; U.S. Pat. No. 5,644,033 |
| CXCR5 (Burkitt's lymphoma receptor 1) | GenBank accession No. NP_001707.1; WO2004040000; WO2004015426; US2003105292; U.S. Pat. No. 6,555,339; WO200261087; WO200157188; WO200172830; WO200022129; WO9928468; U.S. Pat. No. 5,440,021; WO9428931; WO9217497 |
| HLA-DOB | GenBank accession No. NP_002111.1; WO9958658; U.S. Pat. No. 6,153,408; U.S. Pat. No. 5,976,551; U.S. Pat. No. 6,011,146 |
| P2X5 | GenBank accession No. NP_002552.2; WO2004047749; WO2003072035; WO200222660; WO2003093444; WO2003087768; WO2003029277 |
| CD72 (B-cell differentiation antigen CD72, Lyb-2) | GenBank accession No. NP_001773.1; WO2004042346; WO2003026493; WO200075655 |
| CD180 (LY64) | GenBank accession No. NP_005573.1; US2002193567; WO9707198; WO2003083047; WO9744452 |
| FcRH1 (Fc receptor-like protein 1) | GenBank accession No. NP_443170.1) WO2003077836; WO200138490; WO2003089624; EP1347046; WO2003089624 |
| IRTA2 (Immunoglobulin superfamily receptor translocation associated 2) | GenBank accession No. Human: AF343662, AF343663, AF343664, AF343665, AF369794, AF397453; WO2003024392; WO2003077836; WO200138490 |
| TENB2 (TMEFF2, tomoregulin, TPEF, HPP1) | GenBank accession No. AF179274; AY358907, CAF85723, CQ782436; WO2004074320; WO2003042661; WO2003009814; EP1295944; WO200230268; WO200190304; US2004249130; US2004022727; WO2004063355; US2004197325; US2003232350; US2004005563; US2003124579 |
| CS1 (CRACC, 19A, APEX-1, FOAP12) | GenBank Accession No. NM 021181; US 20100168397 |
| DLL4 | GenBank Accession No. NM 019074; US 20100303812 |
| Lewis Y | ADB235860; U.S. Pat. No. 7,879,983 |
| CD40 (Bp50, CDW40, MGC9013, TNFRSF5, p50) | AL035662.65; U.S. Pat. No. 6,946,129 |
| OBA1 (5T4) | GenBank Accession No. NP_001159864.1; US 20100021483 |
| p97 | Woodbury et al., 1980, Proc. Natl. Acad. Sci. USA 77: 2183-2186; Brown et al., 1981, J. Immunol. 127: 539-546 |
| carcinoembryonic antigen (CEA) | GenBank Accession No. NP_004354.2; U.S. Pat. No. 6,676,924 |
| TAG-72 | U.S. Pat. No. 7,256,004 |
| DNA | |
| Neuropilin-1 (NRP1) | GenBank Accession No. NP_001019799.1; US 20080213268 |
| A33 | GenBank Accession No. NP_005805.1; U.S. Pat. No. 7,579,187 |
| Mucin-1 (MUC1) | GenBank Accession No. NP_001018016.1; NP_001018017.1; U.S. Pat. No. 7,183,388 |
| ED-B fibronectin | U.S. Pat. No. 7,785,591 |
| Thomsen-Friedenreich antigen (TF) | U.S. Pat. No. 7,374,755; US 20100297159 |
| Bombesin receptor | U.S. Pat. No. 5,750,370 |
| CanAg | |
| Carcinoembryonic antigen (CEA) | U.S. Pat. No. 4,818,709 |
| CD13 | |

TABLE 20-continued

Tumor-associated antigen targets

| TAA targets (synonyms) | Accession Number and References |
|---|---|
| CD138 | |
| CD30 | |
| CD47 | |
| CD56 | |
| CD70 | |
| Chondroitin sulfate proteoglygan NG2 | |
| EphA2 | |
| Folate receptor 1 | U.S. Pat. No. 5,547,668 |
| gastrin receptor | |
| GPNMB (human gylcoprotein) NMB (osteoactivin) | |
| GRP receptor subtype | |
| integrin avb3 | US20110166072 |
| LHRHR | US20110104074 |
| LRP receptor | |
| LyP-1 receptor | |
| Nectin-4 | |
| Neurotensin receptor | U.S. Pat. No. 8,058,230 |
| Nucleolin | |
| Somatostatin receptor | |
| TIM1 | |
| VPAC1 | |
| VPAC2 | |
| Alpha-MSH receptor | |
| CD25 | |
| Interleukin-1 receptor | |

In particular embodiments, the invention provides XTEN-payload conjugates comprising one, two or more targeting components and one, two or more drug components conjugated to XTEN. Non-limiting embodiments of specific conjugate compositions are provided in Table 21, in which the named composition of column 2 has specified components of: i) XTEN sequences of Table 3 designated in the XTEN column of the Table; ii) targeting moiety payloads specified in the Targeting Moiety column of the Table that provide targeting capability of the composition (with the number of moieties specified; e.g., 1× or 3×); and iii) drug pharmacophore specified in the Drug Moiety column of the Table (with the number of drug molecules conjugated to the XTEN; e.g., 3× or 9×). As would be appreciated by one of skill in the art, the invention contemplates other combinations of the disclosed components, as well as different numbers or ratios of the respective specified components, as well as different XTEN sequences to which the payloads are conjugated. For example, the invention contemplates that the number of drug moieties attached to a given XTEN can be 1, or 2, or 3, or 4, or 5, or 6, or 7, or 8, or 9, or 10 or more and that the XTEN would have, for example, the corresponding number of cysteine or lysine residues to which the drug moieties would be conjugated. Further, the invention contemplates that the number of targeting moieties attached to the conjugate can be 1, or 2, or 3 or more, which would similarly be linked to XTEN with an N-terminal amino group or a corresponding number of lysine or cysteine residues.

TABLE 21

Exemplary conjugates

| Conjugate | Conjugate Name* | XTEN linked to Targeting Moiety** | XTEN linked to Drug Moiety** | Targeting Moiety* | Drug Moiety* |
|---|---|---|---|---|---|
| 1 | 1xLHRH-XTEN-3xDox | | Seg 174 | 1xLHRH | 3xDoxorubicin |
| 2 | 1xLHRH-XTEN-9xDox | | Seg 175 | 1xLHRH | 9xDoxorubicin |
| 3 | 3xLHRH-XTEN-3xDox | Seg 176 | Seg 176 | 3xLHRH | 3xDoxorubicin |
| 4 | 3xLHRH-XTEN-9xDox | Seg 176 | Seg 177 | 3xLHRH | 9xDoxorubicin |
| 5 | XTEN-3xDox | | Seg 174 | | 3xDoxorubicin |
| 6 | XTEN-9xDox | | Seg 175 | | 9xDoxorubicin |
| 7 | 1xLHRH-XTEN-3xMMAE | | Seg 174 | 1xLHRH | 3xMMAE *** |
| 8 | 1xLHRH-XTEN-9xMMAE | | Seg 175 | 1xLHRH | 9xMMAE |
| 9 | 3xLHRH-XTEN-3xMMAE | Seg 176 | Seg 176 | 3xLHRH | 3xMMAE |
| 10 | 3xLHRH-XTEN-9xMMAE | Seg 176 | Seg 177 | 3xLHRH | 9xMMAE |
| 11 | XTEN-3xMMAE | | Seg 174 | | 3xMMAE |
| 12 | XTEN-9xMMAE | | Seg 175 | | 9xMMAE |
| 13 | 1xLHRH-XTEN-3xMMAF | | Seg 174 | 1xLHRH | 3xMMAF **** |
| 14 | 1xLHRH-XTEN-9xMMAF | | Seg 175 | 1xLHRH | 9xMMAF |
| 15 | 3xLHRH-XTEN-3xMMAF | Seg 176 | Seg 176 | 3xLHRH | 3xMMAF |

TABLE 21-continued

Exemplary conjugates

| Conjugate | Conjugate Name* | XTEN linked to Targeting Moiety** | XTEN linked to Drug Moiety** | Targeting Moiety* | Drug Moiety* |
|---|---|---|---|---|---|
| 16 | 3xLHRH-XTEN-9xMMAF | Seg 176 | Seg 177 | 3xLHRH | 9xMMAF |
| 17 | XTEN-3xMMAF | | Seg 174 | | 3xMMAF |
| 18 | XTEN-9xMMAF | | Seg 175 | | 9xMMAF |
| 19 | 1xLHRH-XTEN-3xMertansine | | Seg 174 | 1xLHRH | 3xMertansine |
| 20 | 1xLHRH-XTEN-9xMertansine | | Seg 175 | 1xLHRH | 9xMertansine |
| 21 | 3xLHRH-XTEN-3xMertansine | Seg 176 | Seg 176 | 3xLHRH | 3xMertansine |
| 22 | 3xLHRH-XTEN-9xMertansine | Seg 176 | Seg 177 | 3xLHRH | 9xMertansine |
| 23 | XTEN-3xMertansine | | Seg 174 | | 3xMertansine |
| 24 | XTEN-9xMertansine | | Seg 175 | | 9xMertansine |
| 25 | 1xLHRH-XTEN-3xMaytansinoid DM4 | | Seg 174 | 1xLHRH | 3xMaytansinoid DM4 |
| 26 | 1xLHRH-XTEN-9xMaytansinoid DM4 | | Seg 175 | 1xLHRH | 9xMaytansinoid DM4 |
| 27 | 3xLHRH-XTEN-3xMaytansinoid DM4 | Seg 176 | Seg 176 | 3xLHRH | 3xMaytansinoid DM4 |
| 28 | 3xLHRH-XTEN-9xMaytansinoid DM4 | Seg 176 | Seg 177 | 3xLHRH | 9xMaytansinoid DM4 |
| 29 | XTEN-3xMaytansinoid DM4 | | Seg 174 | | 3xMaytansinoid DM4 |
| 30 | XTEN-9xMaytansinoid DM4 | | Seg 175 | | 9xMaytansinoid DM4 |
| 31 | 1xLHRH-XTEN-3xPaclitaxel | | Seg 174 | 1xLHRH | 3xPaclitaxel |
| 32 | 1xLHRH-XTEN-9xPaclitaxel | | Seg 175 | 1xLHRH | 9xPaclitaxel |
| 33 | 3xLHRH-XTEN-3xPaclitaxel | Seg 176 | Seg 176 | 3xLHRH | 3xPaclitaxel |
| 34 | 3xLHRH-XTEN-9xPaclitaxel | Seg 176 | Seg 177 | 3xLHRH | 9xPaclitaxel |
| 35 | XTEN-3xPaclitaxel | | Seg 174 | | 3xPaclitaxel |
| 36 | XTEN-9xPaclitaxel | | Seg 175 | | 9xPaclitaxel |
| 37 | 1xLHRH-XTEN-3xSN-38 | | Seg 174 | 1xLHRH | 3xSN-38 |
| 38 | 1xLHRH-XTEN-9xSN-38 | | Seg 175 | 1xLHRH | 9xSN-38 |
| 39 | 3xLHRH-XTEN-3xSN-38 | Seg 176 | Seg 176 | 3xLHRH | 3xSN-38 |
| 40 | 3xLHRH-XTEN-9xSN-38 | Seg 176 | Seg 177 | 3xLHRH | 9xSN-38 |
| 41 | XTEN-3xSN-38 | | Seg 174 | | 3xSN-38 |
| 42 | XTEN-9xSN-38 | | Seg 175 | | 9xSN-38 |
| 43 | 1xLHRH-XTEN-3xGemcitabine | | Seg 174 | 1xLHRH | 3xGemcitabine |
| 44 | 1xLHRH-XTEN-9xGemcitabine | | Seg 175 | 1xLHRH | 9xGemcitabine |
| 45 | 3xLHRH-XTEN-3xGemcitabine | Seg 176 | Seg 176 | 3xLHRH | 3xGemcitabine |
| 46 | 3xLHRH-XTEN-9xGemcitabine | Seg 176 | Seg 177 | 3xLHRH | 9xGemcitabine |
| 47 | XTEN-3xGemcitabine | | Seg 174 | | 3xGemcitabine |
| 48 | XTEN-9xGemcitabine | | Seg 175 | | 9xGemcitabine |
| 49 | 1xLHRH-XTEN-3xCarboplatin | | Seg 174 | 1xLHRH | 3xCarboplatin |
| 50 | 1xLHRH-XTEN-9xCarboplatin | | Seg 175 | 1xLHRH | 9xCarboplatin |
| 51 | 3xLHRH-XTEN-3xCarboplatin | Seg 176 | Seg 176 | 3xLHRH | 3xCarboplatin |
| 52 | 3xLHRH-XTEN-9xCarboplatin | Seg 176 | Seg 177 | 3xLHRH | 9xCarboplatin |
| 53 | XTEN-3xCarboplatin | | Seg 174 | | 3xCarboplatin |
| 54 | XTEN-9xCarboplatin | | Seg 175 | | 9xCarboplatin |
| 55 | 1xLHRH-XTEN-Human RNase | | | 1xLHRH | Human RNase |
| 56 | 3xLHRH-XTEN-Human RNase | | | 3xLHRH | Human RNase |
| 57 | 1xLHRH-XTEN-Bovine RNase | | | 1xLHRH | Bovine RNase |
| 58 | 3xLHRH-XTEN-Bovine RNase | | | 3xLHRH | Bovine RNase |
| 59 | 1xLHRH-XTEN-Ranpirnase | | | 1xLHRH | Ranpirnase |
| 60 | 3xLHRH-XTEN-Ranpirnase | | | 3xLHRH | Ranpirnase |

TABLE 21-continued

Exemplary conjugates

| Conjugate | Conjugate Name* | XTEN linked to Targeting Moiety** | XTEN linked to Drug Moiety** | Targeting Moiety* | Drug Moiety* |
|---|---|---|---|---|---|
| 61 | 1xLHRH-XTEN-Pokeweed antiviral protein | | | 1xLHRH | Pokeweed antiviral protein |
| 62 | 3xLHRH-XTEN-Pokeweed antiviral protein | | | 3xLHRH | Pokeweed antiviral protein |
| 63 | 1xfolate-XTEN-3xDox | | Seg 174 | 1xfolate | 3xDoxorubicin |
| 64 | 1xfolate-XTEN-9xDox | | Seg 175 | 1xfolate | 9xDoxorubicin |
| 65 | 3xfolate-XTEN-3xDox | Seg 176 | Seg 176 | 3xfolate | 3xDoxorubicin |
| 66 | 3xfolate-XTEN-9xDox | Seg 176 | Seg 177 | 3xfolate | 9xDoxorubicin |
| 67 | XTEN-3xDox | | Seg 174 | | 3xDoxorubicin |
| 68 | XTEN-9xDox | | Seg 175 | | 9xDoxorubicin |
| 69 | 1xfolate-XTEN-3xMMAE | | Seg 174 | 1xfolate | 3xMMAE |
| 70 | 1xfolate-XTEN-9xMMAE | | Seg 175 | 1xfolate | 9xMMAE |
| 71 | 3xfolate-XTEN-3xMMAE | Seg 176 | Seg 176 | 3xfolate | 3xMMAE |
| 72 | 3xfolate-XTEN-9xMMAE | Seg 176 | Seg 177 | 3xfolate | 9xMMAE |
| 73 | XTEN-3xMMAE | | Seg 174 | | 3xMMAE |
| 74 | XTEN-9xMMAE | | Seg 175 | | 9xMMAE |
| 75 | 1xfolate-XTEN-3xMMAF | | Seg 174 | 1xfolate | 3xMMAF |
| 76 | 1xfolate-XTEN-9xMMAF | | Seg 175 | 1xfolate | 9xMMAF |
| 77 | 3xfolate-XTEN-3xMMAF | Seg 176 | Seg 176 | 3xfolate | 3xMMAF |
| 78 | 3xfolate-XTEN-9xMMAF | Seg 176 | Seg 177 | 3xfolate | 9xMMAF |
| 79 | XTEN-3xMMAF | | Seg 174 | | 3xMMAF |
| 80 | XTEN-9xMMAF | | Seg 175 | | 9xMMAF |
| 81 | 1xfolate-XTEN-3xMertansine | | Seg 174 | 1xfolate | 3xMertansine |
| 82 | 1xfolate-XTEN-9xMertansine | | Seg 175 | 1xfolate | 9xMertansine |
| 83 | 3xfolate-XTEN-3xMertansine | Seg 176 | Seg 176 | 3xfolate | 3xMertansine |
| 84 | 3xfolate-XTEN-9xMertansine | Seg 176 | Seg 177 | 3xfolate | 9xMertansine |
| 85 | XTEN-3xMertansine | | Seg 174 | | 3xMertansine |
| 86 | XTEN-9xMertansine | | Seg 175 | | 9xMertansine |
| 87 | 1xfolate-XTEN-3xMaytansinoid DM4 | | Seg 174 | 1xfolate | 3xMaytansinoid DM4 |
| 88 | 1xfolate-XTEN-9xMaytansinoid DM4 | | Seg 175 | 1xfolate | 9xMaytansinoid DM4 |
| 89 | 3xfolate-XTEN-3xMaytansinoid DM4 | Seg 176 | Seg 176 | 3xfolate | 3xMaytansinoid DM4 |
| 90 | 3xfolate-XTEN-9xMaytansinoid DM4 | Seg 176 | Seg 177 | 3xfolate | 9xMaytansinoid DM4 |
| 91 | XTEN-3xMaytansinoid DM4 | | Seg 174 | | 3xMaytansinoid DM4 |
| 92 | XTEN-9xMaytansinoid DM4 | | Seg 175 | | 9xMaytansinoid DM4 |
| 93 | 1xfolate-XTEN-3xPaclitaxel | | Seg 174 | 1xfolate | 3xPaclitaxel |
| 94 | 1xfolate-XTEN-9xPaclitaxel | | Seg 175 | 1xfolate | 9xPaclitaxel |
| 95 | 3xfolate-XTEN-3xPaclitaxel | Seg 176 | Seg 176 | 3xfolate | 3xPaclitaxel |
| 96 | 3xfolate-XTEN-9xPaclitaxel | Seg 176 | Seg 177 | 3xfolate | 9xPaclitaxel |
| 97 | XTEN-3xPaclitaxel | | Seg 174 | | 3xPaclitaxel |
| 98 | XTEN-9xPaclitaxel | | Seg 175 | | 9xPaclitaxel |
| 99 | 1xfolate-XTEN-3xSN-38 | | Seg 174 | 1xfolate | 3xSN-38 |
| 100 | 1xfolate-XTEN-9xSN-38 | | Seg 175 | 1xfolate | 9xSN-38 |
| 101 | 3xfolate-XTEN-3xSN-38 | Seg 176 | Seg 176 | 3xfolate | 3xSN-38 |
| 102 | 3xfolate-XTEN-9xSN-38 | Seg 176 | Seg 177 | 3xfolate | 9xSN-38 |
| 103 | XTEN-3xSN-38 | | Seg 174 | | 3xSN-38 |
| 104 | XTEN-9xSN-38 | | Seg 175 | | 9xSN-38 |
| 105 | 1xfolate-XTEN-3xGemcitabine | | Seg 174 | 1xfolate | 3xGemcitabine |
| 106 | 1xfolate-XTEN-9xGemcitabine | | Seg 175 | 1xfolate | 9xGemcitabine |
| 107 | 3xfolate-XTEN-3xGemcitabine | Seg 176 | Seg 176 | 3xfolate | 3xGemcitabine |
| 108 | 3xfolate-XTEN-9xGemcitabine | Seg 176 | Seg 177 | 3xfolate | 9xGemcitabine |
| 109 | XTEN-3xGemcitabine | | Seg 174 | | 3xGemcitabine |
| 110 | XTEN-9xGemcitabine | | Seg 175 | | 9xGemcitabine |
| 111 | 1xfolate-XTEN-3xCarboplatin | | Seg 174 | 1xfolate | 3xCarboplatin |
| 112 | 1xfolate-XTEN-9xCarboplatin | | Seg 175 | 1xfolate | 9xCarboplatin |
| 113 | 3xfolate-XTEN-3xCarboplatin | Seg 176 | Seg 176 | 3xfolate | 3xCarboplatin |
| 114 | 3xfolate-XTEN-9xCarboplatin | Seg 176 | Seg 177 | 3xfolate | 9xCarboplatin |
| 115 | XTEN-3xCarboplatin | | Seg 174 | | 3xCarboplatin |
| 116 | XTEN-9xCarboplatin | | Seg 175 | | 9xCarboplatin |
| 117 | 1xoctreotide-XTEN-3xDox | | Seg 174 | 1xoctreotide | 3xDoxorubicin |
| 118 | 1xoctreotide-XTEN-9xDox | | Seg 175 | 1xoctreotide | 9xDoxorubicin |
| 119 | 3xoctreotide-XTEN-3xDox | Seg 176 | Seg 176 | 3xoctreotide | 3xDoxorubicin |

TABLE 21-continued

Exemplary conjugates

| Conjugate | Conjugate Name* | XTEN linked to Targeting Moiety** | XTEN linked to Drug Moiety** | Targeting Moiety* | Drug Moiety* |
|---|---|---|---|---|---|
| 120 | 3xoctreotide-XTEN-9xDox | Seg 176 | Seg 177 | 3xoctreotide | 9xDoxorubicin |
| 121 | XTEN-3xDox | | Seg 174 | | 3xDoxorubicin |
| 122 | XTEN-9xDox | | Seg 175 | | 9xDoxorubicin |
| 123 | 1xoctreotide-XTEN-3xMMAE | | Seg 174 | 1xoctreotide | 3xMMAE |
| 124 | 1xoctreotide-XTEN-9xMMAE | | Seg 175 | 1xoctreotide | 9xMMAE |
| 125 | 3xoctreotide-XTEN-3xMMAE | Seg 176 | Seg 176 | 3xoctreotide | 3xMMAE |
| 126 | 3xoctreotide-XTEN-9xMMAE | Seg 176 | Seg 177 | 3xoctreotide | 9xMMAE |
| 127 | XTEN-3xMMAE | | Seg 174 | | 3xMMAE |
| 128 | XTEN-9xMMAE | | Seg 175 | | 9xMMAE |
| 129 | 1xoctreotide-XTEN-3xMMAF | | Seg 174 | 1xoctreotide | 3xMMAF |
| 130 | 1xoctreotide-XTEN-9xMMAF | | Seg 175 | 1xoctreotide | 9xMMAF |
| 131 | 3xoctreotide-XTEN-3xMMAF | Seg 176 | Seg 176 | 3xoctreotide | 3xMMAF |
| 132 | 3xoctreotide-XTEN-9xMMAF | Seg 176 | Seg 177 | 3xoctreotide | 9xMMAF |
| 133 | XTEN-3xMMAF | | Seg 174 | | 3xMMAF |
| 134 | XTEN-9xMMAF | | Seg 175 | | 9xMMAF |
| 135 | 1xoctreotide-XTEN-3xMertansine | | Seg 174 | 1xoctreotide | 3xMertansine |
| 136 | 1xoctreotide-XTEN-9xMertansine | | Seg 175 | 1xoctreotide | 9xMertansine |
| 137 | 3xoctreotide-XTEN-3xMertansine | Seg 176 | Seg 176 | 3xoctreotide | 3xMertansine |
| 138 | 3xoctreotide-XTEN-9xMertansine | Seg 176 | Seg 177 | 3xoctreotide | 9xMertansine |
| 139 | XTEN-3xMertansine | | Seg 174 | | 3xMertansine |
| 140 | XTEN-9xMertansine | | Seg 175 | | 9xMertansine |
| 141 | 1xoctreotide-XTEN-3xMaytansinoid DM4 | | Seg 174 | 1xoctreotide | 3xMaytansinoid DM4 |
| 142 | 1xoctreotide-XTEN-9xMaytansinoid DM4 | | Seg 175 | 1xoctreotide | 9xMaytansinoid DM4 |
| 143 | 3xoctreotide-XTEN-3xMaytansinoid DM4 | Seg 176 | Seg 176 | 3xoctreotide | 3xMaytansinoid DM4 |
| 144 | 3xoctreotide-XTEN-9xMaytansinoid DM4 | Seg 176 | Seg 177 | 3xoctreotide | 9xMaytansinoid DM4 |
| 145 | XTEN-3xMaytansinoid DM4 | | Seg 174 | | 3xMaytansinoid DM4 |
| 146 | XTEN-9xMaytansinoid DM4 | | Seg 175 | | 9xMaytansinoid DM4 |
| 147 | 1xoctreotide-XTEN-3xPaclitaxel | | Seg 174 | 1xoctreotide | 3xPaclitaxel |
| 148 | 1xoctreotide-XTEN-9xPaclitaxel | | Seg 175 | 1xoctreotide | 9xPaclitaxel |
| 149 | 3xoctreotide-XTEN-3xPaclitaxel | Seg 176 | Seg 176 | 3xoctreotide | 3xPaclitaxel |
| 150 | 3xoctreotide-XTEN-9xPaclitaxel | Seg 176 | Seg 177 | 3xoctreotide | 9xPaclitaxel |
| 151 | XTEN-3xPaclitaxel | | Seg 174 | | 3xPaclitaxel |
| 152 | XTEN-9xPaclitaxel | | Seg 175 | | 9xPaclitaxel |
| 153 | 1xoctreotide-XTEN-3xSN-38 | | Seg 174 | 1xoctreotide | 3xSN-38 |
| 154 | 1xoctreotide-XTEN-9xSN-38 | | Seg 175 | 1xoctreotide | 9xSN-38 |
| 155 | 3xoctreotide-XTEN-3xSN-38 | Seg 176 | Seg 176 | 3xoctreotide | 3xSN-38 |
| 156 | 3xoctreotide-XTEN-9xSN-38 | Seg 176 | Seg 177 | 3xoctreotide | 9xSN-38 |
| 157 | XTEN-3xSN-38 | | Seg 174 | | 3xSN-38 |
| 158 | XTEN-9xSN-38 | | Seg 175 | | 9xSN-38 |
| 159 | 1xoctreotide-XTEN-3xGemcitabine | | Seg 174 | 1xoctreotide | 3xGemcitabine |
| 160 | 1xoctreotide-XTEN-9xGemcitabine | | Seg 175 | 1xoctreotide | 9xGemcitabine |
| 161 | 3xoctreotide-XTEN-3xGemcitabine | Seg 176 | Seg 176 | 3xoctreotide | 3xGemcitabine |
| 162 | 3xoctreotide-XTEN-9xGemcitabine | Seg 176 | Seg 177 | 3xoctreotide | 9xGemcitabine |
| 163 | XTEN-3xGemcitabine | | Seg 174 | | 3xGemcitabine |
| 164 | XTEN-9xGemcitabine | | Seg 175 | | 9xGemcitabine |
| 165 | 1xoctreotide-XTEN-3xCarboplatin | | Seg 174 | 1xoctreotide | 3xCarboplatin |
| 166 | 1xoctreotide-XTEN-9xCarboplatin | | Seg 175 | 1xoctreotide | 9xCarboplatin |
| 167 | 3xoctreotide-XTEN-3xCarboplatin | Seg 176 | Seg 176 | 3xoctreotide | 3xCarboplatin |
| 168 | 3xoctreotide-XTEN-9xCarboplatin | Seg 176 | Seg 177 | 3xoctreotide | 9xCarboplatin |
| 169 | XTEN-3xCarboplatin | | Seg 174 | | 3xCarboplatin |
| 170 | XTEN-9xCarboplatin | | Seg 175 | | 9xCarboplatin |

TABLE 21-continued

Exemplary conjugates

| Conjugate | Conjugate Name* | XTEN linked to Targeting Moiety** | XTEN linked to Drug Moiety** | Targeting Moiety* | Drug Moiety* |
|---|---|---|---|---|---|
| 171 | 1xoctreotide-XTEN-3xEverolimus | | Seg 174 | 1xoctreotide | 3xEverolimus |
| 172 | 1xoctreotide-XTEN-9xEverolimus | | Seg 175 | 1xoctreotide | 9xEverolimus |
| 173 | 3xoctreotide-XTEN-3xEverolimus | Seg 176 | Seg 176 | 3xoctreotide | 3xEverolimus |
| 174 | 3xoctreotide-XTEN-9xEverolimus | Seg 176 | Seg 177 | 3xoctreotide | 9xEverolimus |
| 175 | XTEN-3xEverolimus | | Seg 174 | | 3xEverolimus |
| 176 | XTEN-9xEverolimus | | Seg 175 | | 9xEverolimus |
| 177 | 1xpasireotide-XTEN-3xDox | | Seg 174 | 1xpasireotide | 3xDoxorubicin |
| 178 | 1xpasireotide-XTEN-9xDox | | Seg 175 | 1xpasireotide | 9xDoxorubicin |
| 179 | 3xpasireotide-XTEN-3xDox | Seg 176 | Seg 176 | 3xpasireotide | 3xDoxorubicin |
| 180 | 3xpasireotide-XTEN-9xDox | Seg 176 | Seg 177 | 3xpasireotide | 9xDoxorubicin |
| 181 | XTEN-3xDox | | Seg 174 | | 3xDoxorubicin |
| 182 | XTEN-9xDox | | Seg 175 | | 9xDoxorubicin |
| 183 | 1xpasireotide-XTEN-3xMMAE | | Seg 174 | 1xpasireotide | 3xMMAE |
| 184 | 1xpasireotide-XTEN-9xMMAE | | Seg 175 | 1xpasireotide | 9xMMAE |
| 185 | 3xpasireotide-XTEN-3xMMAE | Seg 176 | Seg 176 | 3xpasireotide | 3xMMAE |
| 186 | 3xpasireotide-XTEN-9xMMAE | Seg 176 | Seg 177 | 3xpasireotide | 9xMMAE |
| 187 | XTEN-3xMMAE | | Seg 174 | | 3xMMAE |
| 188 | XTEN-9xMMAE | | Seg 175 | | 9xMMAE |
| 189 | 1xpasireotide-XTEN-3xMMAF | | Seg 174 | 1xpasireotide | 3xMMAF |
| 190 | 1xpasireotide-XTEN-9xMMAF | | Seg 175 | 1xpasireotide | 9xMMAF |
| 191 | 3xpasireotide-XTEN-3xMMAF | Seg 176 | Seg 176 | 3xpasireotide | 3xMMAF |
| 192 | 3xpasireotide-XTEN-9xMMAF | Seg 176 | Seg 177 | 3xpasireotide | 9xMMAF |
| 193 | XTEN-3xMMAF | | Seg 174 | | 3xMMAF |
| 194 | XTEN-9xMMAF | | Seg 175 | | 9xMMAF |
| 195 | 1xpasireotide-XTEN-3xMertansine | | Seg 174 | 1xpasireotide | 3xMertansine |
| 196 | 1xpasireotide-XTEN-9xMertansine | | Seg 175 | 1xpasireotide | 9xMertansine |
| 197 | 3xpasireotide-XTEN-3xMertansine | Seg 176 | Seg 176 | 3xpasireotide | 3xMertansine |
| 198 | 3xpasireotide-XTEN-9xMertansine | Seg 176 | Seg 177 | 3xpasireotide | 9xMertansine |
| 199 | XTEN-3xMertansine | | Seg 174 | | 3xMertansine |
| 200 | XTEN-9xMertansine | | Seg 175 | | 9xMertansine |
| 201 | 1xpasireotide-XTEN-3xMaytansinoid DM4 | | Seg 174 | 1xpasireotide | 3xMaytansinoid DM4 |
| 202 | 1xpasireotide-XTEN-9xMaytansinoid DM4 | | Seg 175 | 1xpasireotide | 9xMaytansinoid DM4 |
| 203 | 3xpasireotide-XTEN-3xMaytansinoid DM4 | Seg 176 | Seg 176 | 3xpasireotide | 3xMaytansinoid DM4 |
| 204 | 3xpasireotide-XTEN-9xMaytansinoid DM4 | Seg 176 | Seg 177 | 3xpasireotide | 9xMaytansinoid DM4 |
| 205 | -XTEN-3xMaytansinoid DM4 | | Seg 174 | | 3xMaytansinoid DM4 |
| 206 | -XTEN-9xMaytansinoid DM4 | | Seg 175 | | 9xMaytansinoid DM4 |
| 207 | 1xpasireotide-XTEN-3xPaclitaxel | | Seg 174 | 1xpasireotide | 3xPaclitaxel |
| 208 | 1xpasireotide-XTEN-9xPaclitaxel | | Seg 175 | 1xpasireotide | 9xPaclitaxel |
| 209 | 3xpasireotide-XTEN-3xPaclitaxel | Seg 176 | Seg 176 | 3xpasireotide | 3xPaclitaxel |
| 210 | 3xpasireotide-XTEN-9xPaclitaxel | Seg 176 | Seg 177 | 3xpasireotide | 9xPaclitaxel |
| 211 | XTEN-3xPaclitaxel | | Seg 174 | | 3xPaclitaxel |
| 212 | XTEN-9xPaclitaxel | | Seg 175 | | 9xPaclitaxel |
| 213 | 1xpasireotide-XTEN-3xSN-38 | | Seg 174 | 1xpasireotide | 3xSN-38 |
| 214 | 1xpasireotide-XTEN-9xSN-38 | | Seg 175 | 1xpasireotide | 9xSN-38 |
| 215 | 3xpasireotide-XTEN-3xSN-38 | Seg 176 | Seg 176 | 3xpasireotide | 3xSN-38 |
| 216 | 3xpasireotide-XTEN-9xSN-38 | Seg 176 | Seg 177 | 3xpasireotide | 9xSN-38 |
| 217 | XTEN-3xSN-38 | | Seg 174 | | 3xSN-38 |

TABLE 21-continued

Exemplary conjugates

| Conjugate | Conjugate Name* | XTEN linked to Targeting Moiety** | XTEN linked to Drug Moiety** | Targeting Moiety* | Drug Moiety* |
|---|---|---|---|---|---|
| 218 | XTEN-9xSN-38 | | Seg 175 | | 9xSN-38 |
| 219 | 1xpasireotide-XTEN-3xGemcitabine | | Seg 174 | 1xpasireotide | 3xGemcitabine |
| 220 | 1xpasireotide-XTEN-9xGemcitabine | | Seg 175 | 1xpasireotide | 9xGemcitabine |
| 221 | 3xpasireotide-XTEN-3xGemcitabine | Seg 176 | Seg 176 | 3xpasireotide | 3xGemcitabine |
| 222 | 3xpasireotide-XTEN-9xGemcitabine | Seg 176 | Seg 177 | 3xpasireotide | 9xGemcitabine |
| 223 | -XTEN-3xGemcitabine | | Seg 174 | | 3xGemcitabine |
| 224 | -XTEN-9xGemcitabine | | Seg 175 | | 9xGemcitabine |
| 225 | 1xpasireotide-XTEN-3xCarboplatin | | Seg 174 | 1xpasireotide | 3xCarboplatin |
| 226 | 1xpasireotide-XTEN-9xCarboplatin | | Seg 175 | 1xpasireotide | 9xCarboplatin |
| 227 | 3xpasireotide-XTEN-3xCarboplatin | Seg 176 | Seg 176 | 3xpasireotide | 3xCarboplatin |
| 228 | 3xpasireotide-XTEN-9xCarboplatin | Seg 176 | Seg 177 | 3xpasireotide | 9xCarboplatin |
| 229 | -XTEN-3xCarboplatin | | Seg 174 | | 3xCarboplatin |
| 230 | -XTEN-9xCarboplatin | | Seg 175 | | 9xCarboplatin |
| 231 | 1xpasireotide-XTEN-3xEverolimus | | Seg 174 | 1xpasireotide | 3xEverolimus |
| 232 | 1xpasireotide-XTEN-9xEverolimus | | Seg 175 | 1xpasireotide | 9xEverolimus |
| 233 | 3xpasireotide-XTEN-3xEverolimus | Seg 176 | Seg 176 | 3xpasireotide | 3xEverolimus |
| 234 | 3xpasireotide-XTEN-9xEverolimus | Seg 176 | Seg 177 | 3xpasireotide | 9xEverolimus |
| 235 | XTEN-3xEverolimus | | Seg 174 | | 3xEverolimus |
| 236 | XTEN-9xEverolimus | | Seg 175 | | 9xEverolimus |
| 237 | 1xbombesin-XTEN-3xDox | | Seg 174 | 1xbombesin | 3xDoxorubicin |
| 238 | 1xbombesin-XTEN-9xDox | | Seg 175 | 1xbombesin | 9xDoxorubicin |
| 239 | 3xbombesin-XTEN-3xDox | Seg 176 | Seg 176 | 3xbombesin | 3xDoxorubicin |
| 240 | 3xbombesin-XTEN-9xDox | Seg 176 | Seg 177 | 3xbombesin | 9xDoxorubicin |
| 241 | XTEN-3xDox | | Seg 174 | | 3xDoxorubicin |
| 242 | XTEN-9xDox | | Seg 175 | | 9xDoxorubicin |
| 243 | 1xbombesin-XTEN-3xMMAE | | Seg 174 | 1xbombesin | 3xMMAE |
| 244 | 1xbombesin-XTEN-9xMMAE | | Seg 175 | 1xbombesin | 9xMMAE |
| 245 | 3xbombesin-XTEN-3xMMAE | Seg 176 | Seg 176 | 3xbombesin | 3xMMAE |
| 246 | 3xbombesin-XTEN-9xMMAE | Seg 176 | Seg 177 | 3xbombesin | 9xMMAE |
| 247 | XTEN-3xMMAE | | Seg 174 | | 3xMMAE |
| 248 | XTEN-9xMMAE | | Seg 175 | | 9xMMAE |
| 249 | 1xbombesin-XTEN-3xMMAF | | Seg 174 | 1xbombesin | 3xMMAF |
| 250 | 1xbombesin-XTEN-9xMMAF | | Seg 175 | 1xbombesin | 9xMMAF |
| 251 | 3xbombesin-XTEN-3xMMAF | Seg 176 | Seg 176 | 3xbombesin | 3xMMAF |
| 252 | 3xbombesin-XTEN-9xMMAF | Seg 176 | Seg 177 | 3xbombesin | 9xMMAF |
| 253 | XTEN-3xMMAF | | Seg 174 | | 3xMMAF |
| 254 | XTEN-9xMMAF | | Seg 175 | | 9xMMAF |
| 255 | 1xbombesin-XTEN-3xMertansine | | Seg 174 | 1xbombesin | 3xMertansine |
| 256 | 1xbombesin-XTEN-9xMertansine | | Seg 175 | 1xbombesin | 9xMertansine |
| 257 | 3xbombesin-XTEN-3xMertansine | Seg 176 | Seg 176 | 3xbombesin | 3xMertansine |
| 258 | 3xbombesin-XTEN-9xMertansine | Seg 176 | Seg 177 | 3xbombesin | 9xMertansine |
| 259 | XTEN-3xMertansine | | Seg 174 | | 3xMertansine |
| 260 | XTEN-9xMertansine | | Seg 175 | | 9xMertansine |
| 261 | 1xbombesin-XTEN-3xMaytansinoid DM4 | | Seg 174 | 1xbombesin | 3xMaytansinoid DM4 |
| 262 | 1xbombesin-XTEN-9xMaytansinoid DM4 | | Seg 175 | 1xbombesin | 9xMaytansinoid DM4 |
| 263 | 3xbombesin-XTEN-3xMaytansinoid DM4 | Seg 176 | Seg 176 | 3xbombesin | 3xMaytansinoid DM4 |
| 264 | 3xbombesin-XTEN-9xMaytansinoid DM4 | Seg 176 | Seg 177 | 3xbombesin | 9xMaytansinoid DM4 |
| 265 | XTEN-3xMaytansinoid DM4 | | Seg 174 | | 3xMaytansinoid DM4 |
| 266 | XTEN-9xMaytansinoid DM4 | | Seg 175 | | 9xMaytansinoid DM4 |
| 267 | 1xbombesin-XTEN-3xPaclitaxel | | Seg 174 | 1xbombesin | 3xPaclitaxel |

TABLE 21-continued

Exemplary conjugates

| Conjugate | Conjugate Name* | XTEN linked to Targeting Moiety** | XTEN linked to Drug Moiety** | Targeting Moiety* | Drug Moiety* |
|---|---|---|---|---|---|
| 268 | 1xbombesin-XTEN-9xPaclitaxel | | Seg 175 | 1xbombesin | 9xPaclitaxel |
| 269 | 3xbombesin-XTEN-3xPaclitaxel | Seg 176 | Seg 176 | 3xbombesin | 3xPaclitaxel |
| 270 | 3xbombesin-XTEN-9xPaclitaxel | Seg 176 | Seg 177 | 3xbombesin | 9xPaclitaxel |
| 271 | XTEN-3xPaclitaxel | | Seg 174 | | 3xPaclitaxel |
| 272 | XTEN-9xPaclitaxel | | Seg 175 | | 9xPaclitaxel |
| 273 | 1xbombesin-XTEN-3xSN-38 | | Seg 174 | 1xbombesin | 3xSN-38 |
| 274 | 1xbombesin-XTEN-9xSN-38 | | Seg 175 | 1xbombesin | 9xSN-38 |
| 275 | 3xbombesin-XTEN-3xSN-38 | Seg 176 | Seg 176 | 3xbombesin | 3xSN-38 |
| 276 | 3xbombesin-XTEN-9xSN-38 | Seg 176 | Seg 177 | 3xbombesin | 9xSN-38 |
| 277 | XTEN-3xSN-38 | | Seg 174 | | 3xSN-38 |
| 278 | XTEN-9xSN-38 | | Seg 175 | | 9xSN-38 |
| 279 | 1xbombesin-XTEN-3xGemcitabine | | Seg 174 | 1xbombesin | 3xGemcitabine |
| 280 | 1xbombesin-XTEN-9xGemcitabine | | Seg 175 | 1xbombesin | 9xGemcitabine |
| 281 | 3xbombesin-XTEN-3xGemcitabine | Seg 176 | Seg 176 | 3xbombesin | 3xGemcitabine |
| 282 | 3xbombesin-XTEN-9xGemcitabine | Seg 176 | Seg 177 | 3xbombesin | 9xGemcitabine |
| 283 | XTEN-3xGemcitabine | | Seg 174 | | 3xGemcitabine |
| 284 | XTEN-9xGemcitabine | | Seg 175 | | 9xGemcitabine |
| 285 | 1xbombesin-XTEN-3xCarboplatin | | Seg 174 | 1xbombesin | 3xCarboplatin |
| 286 | 1xbombesin-XTEN-9xCarboplatin | | Seg 175 | 1xbombesin | 9xCarboplatin |
| 287 | 3xbombesin-XTEN-3xCarboplatin | Seg 176 | Seg 176 | 3xbombesin | 3xCarboplatin |
| 288 | 3xbombesin-XTEN-9xCarboplatin | Seg 176 | Seg 177 | 3xbombesin | 9xCarboplatin |
| 289 | XTEN-3xCarboplatin | | Seg 174 | | 3xCarboplatin |
| 290 | XTEN-9xCarboplatin | | Seg 175 | | 9xCarboplatin |

*1x, 3x, 9x refers to the number of the indicated moiety conjugated to the XTEN
**refers to XTEN sequence from Table 3; e.g., Seg 174
*** Monomethyl auristatin E
**** Monomethyl auristatin F

V). Pharmaceutical Compositions

The present invention provides pharmaceutical compositions comprising XTEN-payload conjugates of the disclosure. In one embodiment, the pharmaceutical composition comprises a conjugate selected from the group consisting of the conjugates set forth in Table 21 and at least one pharmaceutically acceptable carrier. In one embodiment, the pharmaceutical composition comprises a conjugate comprising at least a first XTEN sequence having at least about 80%, or at least about 90%, or at least about 91%, or at least about 92%, or at least about 93%, or at least about 94%, or at least about 95%, or at least about 96%, or at least about 97%, or at least about 98%, or at least about 99%, or having 100% sequence identity to a sequence selected from the group of sequences set forth in Table 2 and Table 3 wherein the XTEN sequences of the composition are substantially homogeneous in length, and wherein the XTEN is conjugated to at least a first payload selected from the group of payloads set forth in Tables 11, 12, 18, 19, and 21, and wherein the composition further comprises at least one pharmaceutically acceptable carrier. In one embodiment, the invention provides a pharmaceutical composition comprising an XTEN-payload conjugate of any of the embodiments described herein and at least one pharmaceutically acceptable carrier.

The invention provides a method of preparing a pharmaceutical composition, comprising the step of combining a subject conjugate composition of the embodiments with at least one pharmaceutically acceptable carrier into a pharmaceutically acceptable formulation. The XTEN-payload conjugates of the present invention can be formulated according to known methods to prepare pharmaceutically useful compositions, whereby the XTEN-payload is combined in admixture with a pharmaceutically acceptable carrier vehicle, such as aqueous solutions or buffers, pharmaceutically acceptable suspensions and emulsions. Examples of non-aqueous solvents include propyl ethylene glycol, polyethylene glycol and vegetable oils. Therapeutic formulations are prepared for storage by mixing the active ingredient having the desired degree of purity with optional physiologically acceptable carriers, excipients or stabilizers, as described in Remington's Pharmaceutical Sciences 16th edition, Osol, A. Ed. (1980), in the form of lyophilized formulations or aqueous solutions. The pharmaceutical compositions can be administered by any suitable means or route, including subcutaneously, subcutaneously by infusion pump, intramuscularly, and intravenously. It will be appreciated that the preferred route will vary with the disease and age of the recipient, and the severity of the condition being treated. Osmotic pumps may be used as slow release agents in the form of tablets, pills, capsules or implantable devices. Syringe pumps may also be used as slow release agents. Such devices are described in U.S. Pat. Nos. 4,976,696;

4,933,185; 5,017,378; 6,309,370; 6,254,573; 4,435,173; 4,398,908; 6,572,585; 5,298,022; 5,176,502; 5,492,534; 5,318,540; and 4,988,337, the contents of which are incorporated herein by reference. One skilled in the art, considering both the disclosure of this invention and the disclosures of these other patents could produce a syringe pump for the extended release of the compositions of the present invention.

In another embodiment, the invention provides an XTEN-payload conjugate of any of the embodiments described herein for use in making a medicament useful for the treatment of a condition including, but not limited to the conditions set forth in Table 16.

VI). Methods of Treatment

The invention provides a method of treating a disease in a subject, comprising administering to the subject an effective amount of the XTEN-payload conjugate of any of the foregoing embodiments to a subject in need thereof. In one embodiment, the XTEN-payload comprises a single type of payload selected from Tables 11, 12, 18, 19, and 21. In another embodiment, the XTEN-payload comprises a two types of payloads selected from Tables 11, 12, 18, 19, and 21. In another embodiment, the XTEN-payload comprises a two types of payloads in which one payload is selected from Tables 11, 12, and 18 and the second payload is a targeting moiety with binding affinity to a target of Table 20 or is a targeting moiety of any one of Tables 18, 19, or 21. In another embodiment, the XTEN-payload comprises more than three or more types of payloads selected from Tables 11, 12, 18, 19, and 21. In the method, the payload of the conjugate is one that is known in the art to have a beneficial effect or has affinity to a disease target when administered to a subject with a particular disease or condition. In one embodiment, the payload(s) of the composition mediate their therapeutic effect via a common biological pathway. In the foregoing embodiments of the paragraph, the method is useful in treating or ameliorating or preventing a disease selected from cancer, cancer supportive care, cardiovascular, central nervous system, endocrine disease, gastrointestinal, genitourinary, hematological, HIV infection, hormonal system, inflammation, autoimmune disease, infectious diseases, metabolic disease, musculoskeletal disease, nephrology disorders, ophthalmologic diseases, pain, and respiratory. With greater particularity, the disease is selected from Table 16.

In some embodiments of the method of treatment, the conjugate composition can be administered subcutaneously, intramuscularly, or intravenously. In one embodiment, the composition is administered using a therapeutically effective amount. In one embodiment, administration of two or more consecutive doses of the therapeutically effective amount results in a gain in time spent within a therapeutic window for the composition compared to the payload not linked to XTEN and administered using comparable doses to a subject. The gain in time spent within the therapeutic window can be at least three-fold longer than unmodified payload, or alternatively, at least four-fold, or five-fold, or six-fold, or seven-fold, or eight-fold, or nine-fold, or at least 10-fold, or at least 20-fold, or at least about 30-fold, or at least about 50-fold, or at least about 100-fold longer than payload not linked to XTEN.

In one embodiment of the method of treatment, a smaller moles/kg amount of about two-fold less, or about three-fold less, or about four-fold less, or about five-fold less, or about six-fold less, or about eight-fold less, or about 10-fold less or greater of the conjugate or a pharmaceutical composition comprising the conjugate is administered to a subject in need thereof in comparison to the corresponding payload(s) not linked to the XTEN under a dose regimen needed to maintain a therapeutic effect and the conjugate achieves a comparable area under the curve as the corresponding moles/kg amount of the payload(s) not linked to the XTEN needed to maintain a therapeutic effect. In another embodiment, the conjugate or a pharmaceutical composition comprising the conjugate requires less frequent administration for routine treatment of a subject, wherein the dose of conjugate or pharmaceutical composition is administered about every four days, about every seven days, about every 10 days, about every 14 days, about every 21 days, or about monthly to the subject, and the conjugate achieves a comparable area under the curve as the corresponding payload(s) not linked to the XTEN and administered to the subject. In yet other embodiments, an accumulatively smaller amount of about 5%, or about 10%, or about 20%, or about 40%, or about 50%, or about 60%, or about 70%, or about 80%, or about 90%/o less of moles/kg of the conjugate is administered to a subject in comparison to the corresponding amount of the payload(s) not linked to the XTEN under a dose regimen needed to maintain an effective blood concentration, yet the conjugate achieves at least a comparable area under the curve as the corresponding payload(s) not linked to the XTEN. The accumulatively smaller amount is measure for a period of at least about one week, or about 14 days, or about 21 days, or about one month. In some embodiments of the method, the therapeutic effect is a measured parameter, clinical symptom or endpoint known in the art to be associated with the underlying condition of the subject to be treated or prevented.

In one embodiment, the invention provides a method of treating a cancer cell in vitro, comprising administering to a culture of a cancer cell a composition comprising an effective amount of an XTEN-payload composition, wherein a first payload is a targeting moiety and the second payload is a toxin of Table 21. In another embodiment, the invention provides a method of treating a cancer in a subject, comprising administering to the subject a pharmaceutical composition comprising an effective amount of an XTEN-payload composition wherein a first payload is a targeting moiety and the second payload is a toxin of Table 21. In one embodiment of the method, the pharmaceutical composition comprises the composition having the structure set forth in FIG. 117. In another embodiment of the method, the cancer is selected from the group consisting of non-small cell lung cancer or mesothelioma. platinum-resistant ovarian cancer, endometrial cancer, adenocarcinoma of the lung, and refractory advanced tumors. In another embodiment of the method, the administration results in at least a 10%, or 20%, or 30%, or 40%, or 50%, or 60%, or 70%, or 80%, or 90% greater improvement of at least one, two, or three parameters associated with a cancer compared to an untreated subject wherein the parameters are selected from the group consisting of response rate as defined by the Response Evaluation Criteria in Solid Tumors (RECIST), time-to-progression of the cancer (relapse), discovery of local recurrence, discovery of regional metastasis, discovery of distant metastasis, onset of symptoms, hospitalization, increase in pain medication requirement, requirement of salvage chemotherapy, requirement of salvage surgery, requirement of salvage radiotherapy, time-to-treatment failure, and increased time of survival.

In another aspect, the invention provides a regimen for treating a subject with a disease, said regimen comprising a composition comprising a conjugate of any of the embodiments described herein. In one embodiment of the regimen, the regimen further comprises the step of determining the amount of pharmaceutical composition comprising the CFXTEN needed to achieve a therapeutic effect in the patient.

The invention provides conjugates comprising a treatment regimen for a diseased subject comprising administering a pharmaceutical composition comprising a conjugate of any of the embodiments described herein in two or more successive doses administered at an effective amount, wherein the administration results in the improvement of at least one parameter associated with the disease.

VII). Conjugation Kits

In another aspect, the invention provides a kit to facilitate the use of the XTEN-crosslinker conjugate compositions. In one embodiment, the kit comprises an XTEN-crosslinker in a formulation, a container and a label on or associated with the container. In the foregoing embodiment, the XTEN-crosslinker can be any one of the embodiments described herein. The container holds the XTEN-crosslinker at a defined concentration in a buffer suitable for use in a conjugation reaction to link to a payload.

VIII). Pharmaceutical Kits

In another aspect, the invention provides a kit to facilitate the use of the conjugate compositions. The kit comprises a pharmaceutical composition provided herein, a container and a label or package insert on or associated with the container. Suitable containers include, for example, bottles, vials, syringes, etc., formed from a variety of materials such as glass or plastic. The container holds a pharmaceutical composition as a formulation that is effective for treating a subject and may have a sterile access port (for example the container may be an intravenous solution bag or a vial having a stopper pierceable by a hypodermic injection needle). The package insert can list the approved indications for the drug, instructions for the reconstitution and/or administration of the drug for the use for the approved indication, appropriate dosage and safety information, and information identifying the lot and expiration of the drug. In another embodiment of the foregoing, the kit can comprise a second container that can carry a suitable diluent for the pharmaceutical composition, the use of which will provide the user with the appropriate concentration to be delivered to the subject. In another embodiment, the kit comprises, in at least a first container: a first container: an amount of a conjugate composition drug sufficient to administer in treatment of a subject with a disease; an amount of a pharmaceutically acceptable carrier; a second container that can carry a suitable diluent for the subject composition, which will provide the user with the appropriate concentration of the pharmaceutical composition to be delivered to the subject; together with a label identifying the drug and storage and handling conditions, and/or a sheet of the approved indications for the drug and instructions for the reconstitution and/or administration of the drug for the use for the treatment of a approved indication, appropriate dosage and safety information, and information identifying the lot and expiration of the drug.

IX). The Nucleic Acids Sequences of the Invention

The present invention provides isolated polynucleic acids encoding the polypeptide components of the conjugates and sequences complementary to polynucleic acid molecules encoding the polypeptide components of the conjugates. In some embodiments, the invention provides polynucleic acids encoding the XTEN of any of the conjugate embodiments described herein, or the complement of the polynucleic acid. In one embodiment, the polynucleic acids encodes an XTEN selected from the group consisting of the XTEN set forth in Tables 2 and 3, or the complement of the polynucleic acid.

In other embodiments, the invention provides polynucleic acids encoding the XTEN linked to cleavage sequences, affinity tags and helper sequences protein of any of the embodiments described herein, or the complement of the polynucleic acids. In one embodiment, the polynucleic acids encodes a protein payload selected from the group consisting of the protein payloads set forth in Tables 7, 18, 19, and 21, or the complement of the polynucleic acid.

Figure 38:
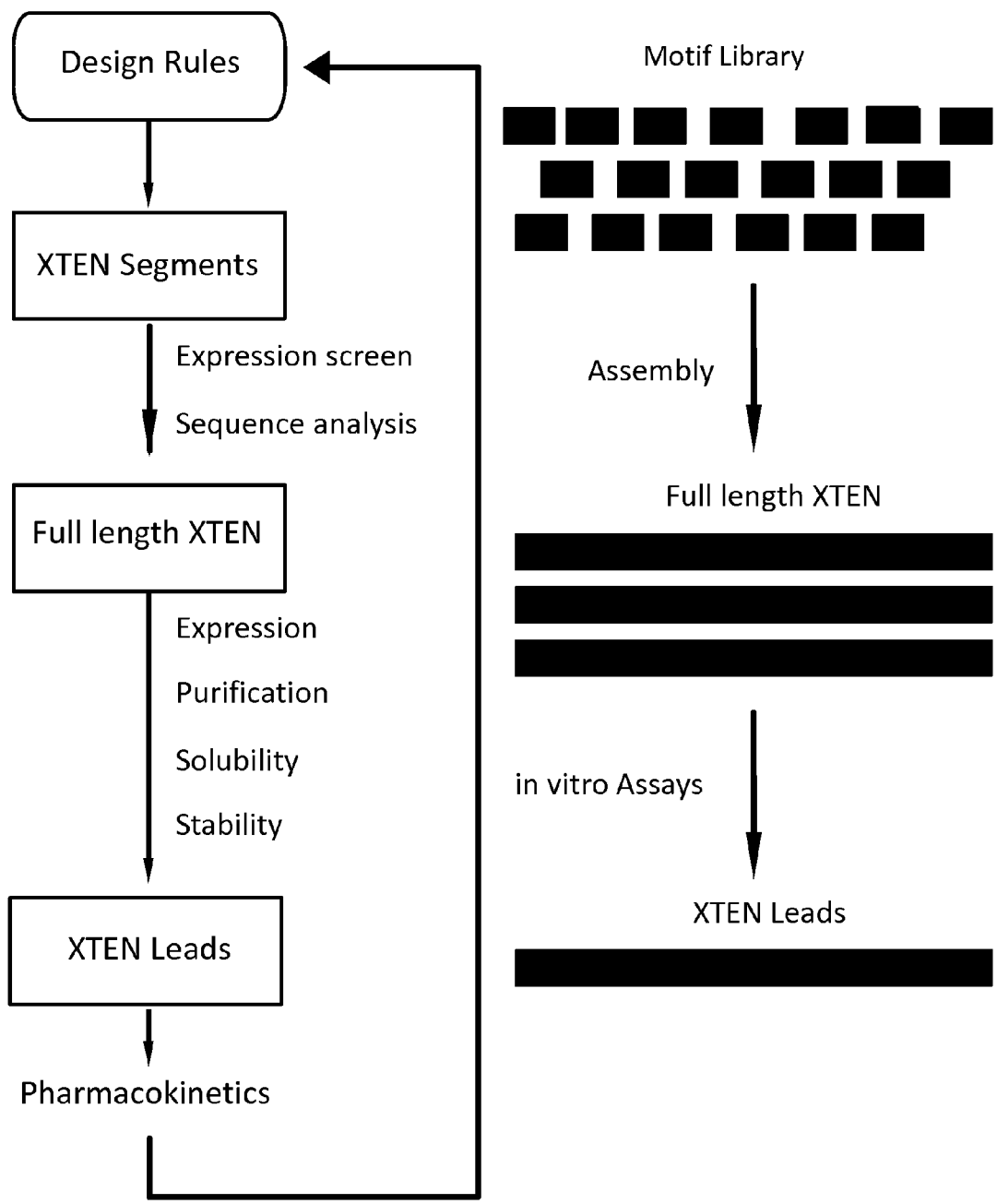
FIG. 38 is a schematic flowchart of representative steps in the assembly, production and the evaluation of a XTEN.
Figure 39:
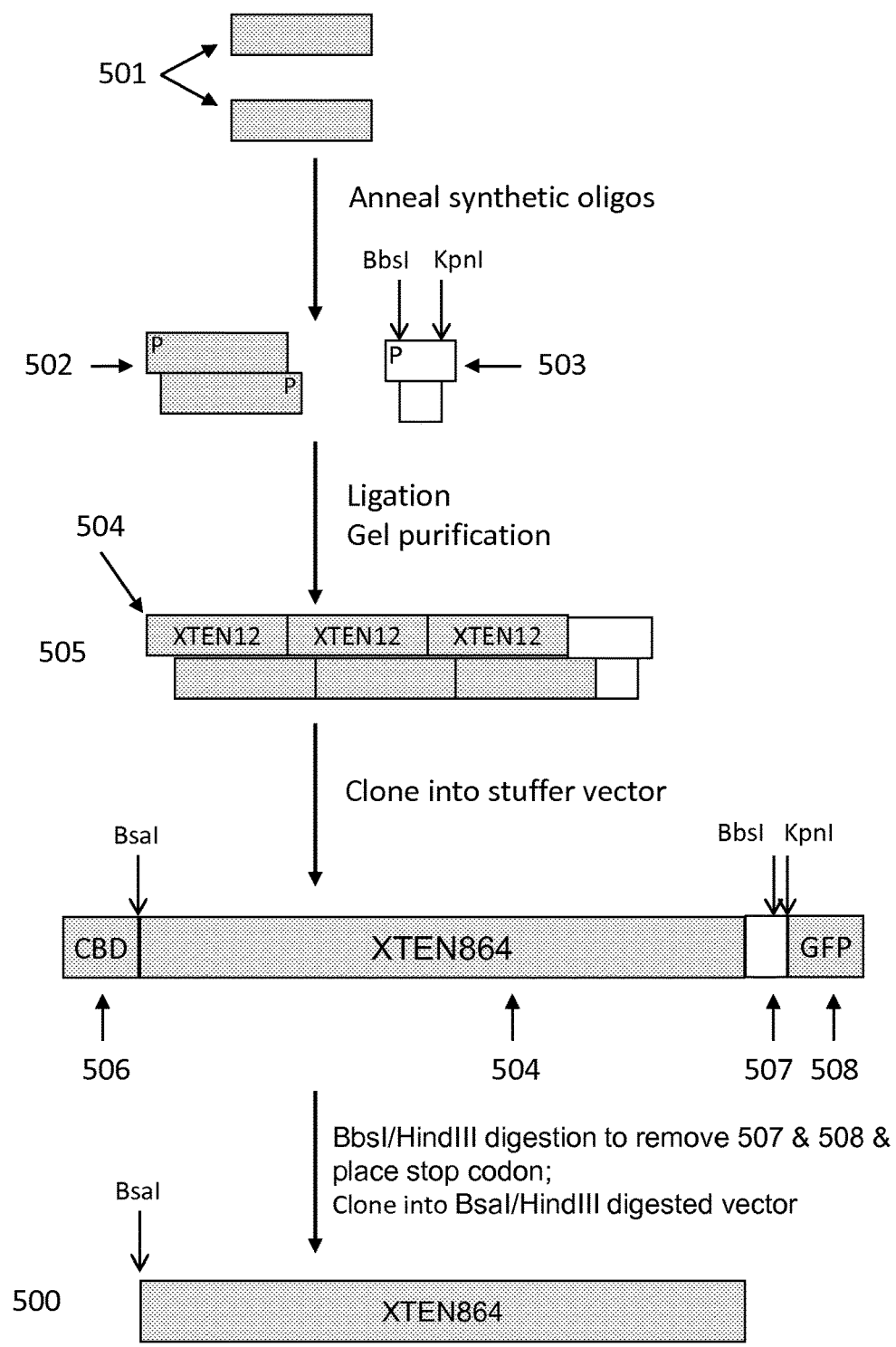
FIG. 39 is a schematic flowchart of representative steps in the assembly of an XTEN polynucleotide construct encoding a fusion protein. Individual oligonucleotides 501 are annealed into sequence motifs 502 such as a 12 amino acid motif ("12-mer"), which is ligated to additional sequence motifs from a library to create a pool that encompasses the desired length of the XTEN 504, as well as ligated to a smaller concentration of an oligo containing BbsI, and KpnI restriction sites 503. The resulting pool of ligation products is gel-purified and the band with the desired length of XTEN is cut, resulting in an isolated XTEN gene with a stopper sequence 505. The XTEN gene is cloned into a stuffer vector. In this case, the vector encodes an optional CBD sequence 506 and a GFP gene 508. Digestion is then performed with BbsI/HindIII to remove 507 and 508 and place the stop codon. The resulting product is then cloned into a BsaI/HindIII digested vector, resulting in gene 500 encoding an XTEN.

In one embodiment, the invention encompasses methods to produce polynucleic acids encoding the XTEN and the XTEN linked to cleavage sequences, affinity tags and helper sequences protein embodiments, or sequences complementary to the polynucleic acids, including homologous variants thereof. In general, and as illustrated in FIGS. 38 and 39, the methods of producing a polynucleotide sequence coding for an XTEN and expressing the resulting gene product include assembling nucleotides encoding the XTEN, ligating the components in frame, incorporating the encoding gene into an expression vector appropriate for a host cell, transforming the appropriate host cell with the expression vector, and culturing the host cell under conditions causing or permitting the XTEN to be expressed in the transformed host cell, thereby producing the XTEN polypeptide, which is recovered by methods described herein or by standard protein purification methods known in the art. Standard recombinant techniques in molecular biology are used to make the polynucleotides and expression vectors of the present invention.

In accordance with the invention, nucleic acid sequences that encode XTEN or XTEN linked to cleavage sequences, affinity tags and helper sequences protein (or its complement) are used to generate recombinant DNA molecules that direct the expression in appropriate host cells. Several cloning strategies are suitable for performing the present invention, many of which are used to generate a construct that comprises a gene coding for an XTEN or a payload composition of the present invention, or its complement. In one embodiment, the cloning strategy is used to create a gene that encodes an XTEN that comprises nucleotides encoding the XTEN that is used to transform a host cell for expression of the XTEN composition. In the foregoing embodiments hereinabove described in this paragraph, the genes can further comprise nucleotides encoding cleavage sequences, affinity tags, and helper sequences. In another embodiment, the cloning strategy is used to create a gene that encodes a protein payload that comprises nucleotides encoding the payload that is used to transform a host cell for expression of the payload composition.

In designing a desired XTEN sequences, it was discovered that the non-repetitive nature of the XTEN of the inventive compositions is achieved despite use of a "building block" molecular approach in the creation of the XTEN-encoding sequences. This was achieved by the use of a library of polynucleotides encoding peptide sequence motifs, described above, that are then ligated and/or multimerized to create the genes encoding the XTEN sequences (see FIGS. 38 and 39 and Examples). Thus, while the XTEN(s) of the expressed polypeptide may consist of multiple units of as few as four different sequence motifs, because the motifs themselves consist of non-repetitive amino acid sequences, the overall XTEN sequence is rendered non-repetitive. Accordingly, in one embodiment, the XTEN-encoding polynucleotides comprise multiple polynucleotides that encode non-repetitive sequences, or motifs, operably linked in frame and in which the resulting expressed XTEN amino acid sequences are non-repetitive.

In one approach, a construct is first prepared containing the DNA sequence corresponding to XTEN. Exemplary methods for the preparation of such constructs are described in the Examples. The construct is then used to create an expression vector suitable for transforming a host cell, such as a prokaryotic host cell (e.g., E. coli) for the expression and recovery of the XTEN. Exemplary methods for the creation of expression vectors, the transformation of host cells and the expression and recovery of XTEN are described in the Examples.

The gene encoding for the XTEN can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate short sequences of polynucleotides encoding XTEN into longer XTEN genes of a desired length and sequence. In one embodiment, the method ligates two, three, four or more codon-optimized oligonucleotides encoding XTEN motif or segment sequences of about 9 to 14 amino acids, or about 12 to 20 amino acids, or about 18 to 36 amino acids, or about 48 to about 144 amino acids, or about 144 to about 288 or longer, or any combination of the foregoing ranges of motif or segment lengths. Alternatively, the disclosed method is used to multimerize XTEN-encoding sequences into longer sequences of a desired length; e.g., a gene encoding 36 amino acids of XTEN can be dimerized into a gene encoding 72 amino acids, then 144, then 288, etc. Even with multimerization, XTEN polypeptides can be constructed such that the XTEN-encoding gene has low or virtually no repetitiveness through design of the codons selected for the motifs of the shortest unit being used, which can reduce recombination and increase stability of the encoding gene in the transformed host. Genes encoding XTEN with non-repetitive sequences are assembled from oligonucleotides using standard techniques of gene synthesis. The gene design can be performed using algorithms that optimize codon usage and amino acid composition. In one method of the invention, a library of relatively short XTEN-encoding polynucleotide constructs is created and then assembled, as described above. The resulting genes are then assembled with genes encoding payload peptide or polypeptide, and the resulting genes used to transform a host cell and produce and recover the XTEN-payload for evaluation of its properties, as described herein.

The resulting polynucleotides encoding the XTEN and the peptide sequences to which it is linked can then be individually cloned into an expression vector. The nucleic acid sequence is inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature. Various vectors are publicly available. The vector may, for example, be in the form of a plasmid, cosmid, viral particle, or phage that may conveniently be subjected to recombinant DNA procedures, and the choice of vector will often depend on the host cell into which it is to be introduced. Thus, the vector may be an autonomously replicating vector, i.e., a vector, which exists as an extrachromosomal entity, the replication of which is independent of chromosomal replication, e.g., a plasmid. Alternatively, the vector may be one which, when introduced into a host cell, is integrated into the host cell genome and replicated together with the chromosome(s) into which it has been integrated. Representative plasmids are illustrated in FIG. 17, with encoding regions for different configurations of FVIII and XTEN components portrayed.

The invention provides for the use of plasmid expression vectors containing replication and control sequences that are compatible with and recognized by the host cell, and are operably linked to the gene encoding the polypeptide for controlled expression of the polypeptide. The vector ordinarily carries a replication site, as well as sequences that encode proteins that are capable of providing phenotypic selection in transformed cells. Such vector sequences are well known for a variety of bacteria, yeast, and viruses. Useful expression vectors that can be used include, for example, segments of chromosomal, non-chromosomal and synthetic DNA sequences. "Expression vector" refers to a DNA construct containing a DNA sequence that is operably linked to a suitable control sequence capable of effecting the expression of the DNA encoding the polypeptide in a suitable host. The requirements are that the vectors are replicable and viable in the host cell of choice. Low- or high-copy number vectors may be used as desired.

Suitable vectors include, but are not limited to, derivatives of SV40 and pcDNA and known bacterial plasmids such as col EI, pCR1, pBR322, pMal-C2, pET, pGEX as described by Smith, et al., Gene 57:31-40 (1988), pMB9 and derivatives thereof, plasmids such as RP4, phage DNAs such as the numerous derivatives of phage I such as NM98 9, as well as other phage DNA such as M13 and filamentous single stranded phage DNA; yeast plasmids such as the 2 micron plasmid or derivatives of the 2 m plasmid, as well as centomeric and integrative yeast shuttle vectors; vectors useful in eukaryotic cells such as vectors useful in insect or mammalian cells; vectors derived from combinations of plasmids and phage DNAs, such as plasmids that have been modified to employ phage DNA or the expression control sequences; and the like. Yeast expression systems that can also be used in the present invention include, but are not limited to, the non-fusion pYES2 vector (Invitrogen), the fusion pYESHisA, B, C (Invitrogen), pRS vectors and the like. The control sequences of the vector include a promoter to effect transcription, an optional operator sequence to control such transcription, a sequence encoding suitable mRNA ribosome binding sites, and sequences that control termination of transcription and translation. The promoter may be any DNA sequence, which shows transcriptional activity in the host cell of choice and may be derived from genes encoding proteins either homologous or heterologous to the host cell. Promoters suitable for use in expression vectors with prokaryotic hosts include the β-lactamase and lactose promoter systems [Chang et al., Nature, 275:615 (1978); Goeddel et al., Nature, 281:544 (1979)], alkaline phosphatase, a tryptophan (trp) promoter system [Goeddel, Nucleic Acids Res., 8:4057 (1980); EP 36,776], and hybrid promoters such as the tac promoter [deBoer et al., Proc. Natl. Acad. Sci. USA, 80:21-25 (1983)], all is operably linked to the DNA encoding CFXTEN polypeptides. Promoters for use in bacterial systems can also contain a Shine-Dalgarno (S.D.) sequence, operably linked to the DNA encoding CFXTEN polypeptides.

EXAMPLES

Example 1: Construction of XTEN_AD36 Motif Segments

The following example describes the construction of a collection of codon-optimized genes encoding motif sequences of 36 amino acids. As a first step, a stuffer vector pCW0359 was constructed based on a pET vector and that includes a T7 promoter. pCW0359 encodes a cellulose binding domain (CBD) and a TEV protease recognition site followed by a stuffer sequence that is flanked by BsaI, BbsI, and KpnI sites. The BsaI and BbsI sites were inserted such that they generate compatible overhangs after digestion. The stuffer sequence is followed by a truncated version of the GFP gene and a His tag. The stuffer sequence contains stop codons and thus E. coli cells carrying the stuffer plasmid pCW0359 form non-fluorescent colonies. The stuffer vector pCW0359 was digested with BsaI and KpnI to remove the stuffer segment and the resulting vector fragment was isolated by agarose gel purification. The sequences were designated XTEN_AD36, reflecting the AD family of motifs. Its segments have the amino acid sequence $[X]_3$ where X is a 12mer peptide with the sequences: GESPGGSSGSES (SEQ ID NO: 26), GSEGSSGPGESS (SEQ ID NO: 27), GSSESGSSEGGP (SEQ ID NO: 28), or GSGGEPSESGSS (SEQ ID NO: 29). The insert was obtained by annealing the following pairs of phosphorylated synthetic oligonucleotide pairs:

```
AD1for:
AGGTGAATCTCCDGGTGGYTCYAGCGGTTCYGARTC
(SEQ ID NO: 612)

AD1rev:
ACCTGAYTCRGAACCGCTRGARCCACCHGGAGATTC
(SEQ ID NO: 613)

AD2for:
AGGTAGCGAAGGTTCTTCYGGTCCDGGYGARTCYTC
(SEQ ID NO: 614)

AD2rev:
ACCTGARGAYTCRCCHGGACCRGAAGAACCTTCGCT
(SEQ ID NO: 615)

AD3for:
AGGTTCYTCYGAAAGCGGTTCTTCYGARGGYGGTCC
(SEQ ID NO: 616)

AD3rev:
ACCTGGACCRCCYTCRGAAGAACCGCTTTCRGARGA
(SEQ ID NO: 617)

AD4for:
AGGTTCYGGTGGYGAACCDTCYGARTCTGGTAGCTC
(SEQ ID NO: 618)
```

We also annealed the phosphorylated oligonucleotide 3KpnIIstopperFor: AGGTCGTCTCACTCGAGGGTAC (SEQ ID NO: 619) and the non-phosphorylated oligonucleotide pr_3KpnIstopperRev: CCTCGAGTGAAGACGA (SEQ ID NO: 620). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0401 showed green fluorescence after induction, which shows that the sequence of XTEN_AD36 had been ligated in frame with the GFP gene and that most sequences of XTEN_AD36 had good expression levels.

We screened 96 isolates from library LCW0401 for high level of fluorescence by stamping them onto agar plate containing IPTG. The same isolates were evaluated by PCR and 48 isolates were identified that contained segments with 36 amino acids as well as strong fluorescence. These isolates were sequenced and 39 clones were identified that contained correct XTEN_AD36 segments. The file names of the nucleotide and amino acid constructs for these segments are listed in Table 22.

TABLE 22

DNA and Amino Acid Sequences for 36-mer motifs

| File name | Amino acid sequence | SEQ ID NO: | Nucleotide sequence | SEQ ID NO: |
|---|---|---|---|---|
| LCW0401_001_ GEP-N_A01.ab1 | GSGGEPSESGSSGESPGG SSGSESGESPGGSSGSES | 621 | GGTTCTGGTGGCGAACCGTCCGAGTCTGGTAGC TCAGGTGAATCTCCGGGTGGCTCTAGCGGTTCC GAGTCAGGTGAATCTCCTGGTGGTTCCAGCGGT TCCGAGTCA | 659 |
| LCW0401_002_ GFP-N_B01.ab1 | GSEGSSGPGESSGESPGG SSGSESGSSESGSSEGGP | 622 | GGTAGCGAAGGTTCTTCTGGTCCTGGCGAGTCT TCAGGTGAATCTCCTGGTGGTTCCAGCGGTTCT GAATCAGGTTCCTCCGAAAGCGGTTCTTCCGAG GGCGGTCCA | 660 |
| LCW0401_003_ GFP-N_C01.ab1 | GSSESGSSEGGPGSSESG SSEGGPGESPGGSSGSES | 623 | GGTTCCTCTGAAAGCGGTTCTTCCGAAGGTGGT CCAGGTTCCTCTGAAAGCGGTTCTTCTGAGGGT GGTCCAGGTGAATCTCCGGGTGGCTCCAGCGGT TCCGAGTCA | 661 |
| LCW0401_004_ GFP-N_D01.ab1 | GSGGEPSESGSSGSSESG SSEGGPGSGGEPSESGSS | 624 | GGTTCCGGTGGCGAACCGTCTGAATCTGGTAGC TCAGGTTCTTCTGAAAGCGGTTCTTCCGAGGGT GGTCCAGGTTCTGGTGGTGAACCTTCCGAGTCT GGTAGCTCA | 662 |
| LCW0401_007_ GFP-N_F01.ab1 | GSSESGSSEGGPGSEGSS GPGESSGSEGSSGPGESS | 625 | GGTTCTTCCGAAAGCGGTTCTTCTGAGGGTGGT CCAGGTAGCGAAGGTTCTTCCGGTCCAGGTGAG TCTTCAGGTAGCGAAGGTTCTTCTGGTCCTGGT GAATCTTCA | 663 |

TABLE 22-continued

DNA and Amino Acid Sequences for 36-mer motifs

| File name | Amino acid sequence | SEQ ID NO: | Nucleotide sequence | SEQ ID NO: |
|---|---|---|---|---|
| LCW0401_008_GFP-N_G01.ab1 | GSSESGSSEGGPGESPGG SSGSESGSEGSSGPGESS | 626 | GGTTCCTCTGAAAGCGGTTCTTCCGAGGGTGGT CCAGGTGAATCTCCAGGTGGTTCCAGCGGTTCT GAGTCAGGTAGCGAAGGTTCTTCTGGTCCAGGT GAATCCTCA | 664 |
| LCW0401_012_GFP-N_H01.ab1 | GSGGEPSESGSSGSGGEP SESGSSGSEGSSGPGESS | 627 | GGTTCTGGTGGTGAACCGTCTGAGTCTGGTAGC TCAGGTTCCGGTGGCGAACCATCCGAATCTGGT AGCTCAGGTAGCGAAGGTTCTTCCGGTCCAGGT GAGTCTTCA | 665 |
| LCW0401_015_GFP-N_A02.ab1 | GSSESGSSEGGPGSEGSS GPGESSGESPGGSSGSES | 628 | GGTTCTTCCGAAAGCGGTTCTTCCGAAGGCGGT CCAGGTAGCGAAGGTTCTTCTGGTCCAGGCGAA TCTTCAGGTGAATCTCCTGGTGGCTCCAGCGGT TCTGAGTCA | 666 |
| LCW0401_016_GFP-N_B02.ab1 | GSSESGSSEGGPGSSESG SSEGGPGSSESGSSEGGP | 629 | GGTTCCTCCGAAAGCGGTTCTTCTGAGGGCGGT CCAGGTTCCTCCGAAAGCGGTTCTTCCGAGGGC GGTCCAGGTTCTTCTGAAAGCGGTTCTTCCGAG GGCGGTCCA | 667 |
| LCW0401_020_GFP-N_E02.ab1 | GSGGEPSESGSSGSEGSS GPGESSGSSESGSSEGGP | 630 | GGTTCCGGTGGCGAACCGTCCGAATCTGGTAGC TCAGGTAGCGAAGGTTCTTCTGGTCCAGGCGAA TCTTCAGGTTCCTCTGAAAGCGGTTCTTCTGAG GGCGGTCCA | 668 |
| LCW0401_022_GFP-N_F02.ab1 | GSGGEPSESGSSGSSESG SSEGGPGSGGEPSESGSS | 631 | GGTTCTGGTGGTGAACCGTCCGAATCTGGTAGC TCAGGTTCTTCCGAAAGCGGTTCTTCTGAAGGT GGTCCAGGTTCCGGTGGCGAACCTTCTGAATCT GGTAGCTCA | 669 |
| LCW0401_024_GFP-N_G02.ab1 | GSGGEPSESGSSGSSESG SSEGGPGESPGGSSGSES | 632 | GGTTCTGGTGGCGAACCGTCCGAATCTGGTAGC TCAGGTTCCTCCGAAAGCGGTTCTTCTGAAGGT GGTCCAGGTGAATCTCCAGGTGGTTCTAGCGGT TCTGAATCA | 670 |
| LCW0401_026_GFP-N_H02.ab1 | GSGGEPSESGSSGESPGG SSGSESGSEGSSGPGESS | 633 | GGTTCTGGTGGCGAACCGTCTGAGTCTGGTAGC TCAGGTGAATCTCCTGGTGGCTCCAGCGGTTCT GAATCAGGTAGCGAAGGTTCTTCTGGTCCTGGT GAATCTTCA | 671 |
| LCW0401_027_GFP-N_A03.ab1 | GSGGEPSESGSSGESPGG SSGSESGSGGEPSESGSS | 634 | GGTTCCGGTGGCGAACCTTCCGAATCTGGTAGC TCAGGTGAATCTCCGGGTGGTTCTAGCGGTTCT GAGTCAGGTTCTGGTGGTGAACCTTCCGAGTCT GGTAGCTCA | 672 |
| LCW0401_028_GFP-N_B03.ab1 | GSSESGSSEGGPGSSESG SSEGGPGSSESGSSEGGP | 635 | GGTTCCTCTGAAAGCGGTTCTTCTGAGGGCGGT CCAGGTTCTTCCGAAAGCGGTTCTTCCGAGGGC GGTCCAGGTTCTTCCGAAAGCGGTTCTTCTGAA GGCGGTCCA | 673 |
| LCW0401_030_GFP-N_C03.ab1 | GESPGGSSGSESGSEGSS GPGESSGSEGSSGPGESS | 636 | GGTGAATCTCCGGGTGGCTCCAGCGGTTCTGAG TCAGGTAGCGAAGGTTCTTCCGGTCCGGGTGAG TCCTCAGGTAGCGAAGGTTCTTCCGGTCCTGGT GAGTCTTCA | 674 |
| LCW0401_031_GFP-N_D03.ab1 | GSGGEPSESGSSGSGGEP SESGSSGSSESGSSEGGP | 637 | GGTTCTGGTGGCGAACCTTCCGAATCTGGTAGC TCAGGTTCCGGTGGTGAACCTTCTGAATCTGGT AGCTCAGGTTCTTCTGAAAGCGGTTCTTCCGAG GCGGTCCA | 675 |
| LCW0401_033_GFP-N_E03.ab1 | GSGGEPSESGSSGSGGEP SESGSSGSGGEPSESGSS | 638 | GGTTCCGGTGGTGAACCTTCTGAATCTGGTAGC TCAGGTTCCGGTGGCGAACCATCCGAGTCTGGT AGCTCAGGTTCCGGTGGTGAACCATCCGAGTCT GGTAGCTCA | 676 |
| LCW0401_037_GFP-N_F03.ab1 | GSGGEPSESGSSGSSESG SSEGGPGSEGSSGPGESS | 639 | GGTTCCGGTGGCGAACCTTCTGAATCTGGTAGC TCAGGTTCCTCCGAAAGCGGTTCTTCTGAGGGC GGTCCAGGTAGCGAAGGTTCTTCTGGTCCGGGC GAGTCTTCA | 677 |
| LCW0401_038_GFP-N_G03.ab1 | GSGGEPSESGSSGSEGSS GPGESSGSGGEPSESGSS | 640 | GGTTCCGGTGGTGAACCGTCCGAGTCTGGTAGC TCAGGTAGCGAAGGTTCTTCTGGTCCGGGTGAG TCTTCAGGTTCTGGTGGCGAACCGTCCGAATCT GGTAGCTCA | 678 |

TABLE 22-continued

DNA and Amino Acid Sequences for 36-mer motifs

| File name | Amino acid sequence | SEQ ID NO: | Nucleotide sequence | SEQ ID NO: |
|---|---|---|---|---|
| LCW0401_039_GFP-N_H03.ab1 | GSGGEPSESGSSGESPGGSSGSESGSGGEPSESGSS | 641 | GGTTCTGGTGGCGAACCGTCCGAATCTGGTAGCTCAGGTGAATCTCCTGGTGGTTCCAGCGGTTCCGAGTCAGGTTCTGGTGGCGAACCTTCCGAATCTGGTAGCTCA | 679 |
| LCW0401_040_GFP-N_A04.ab1 | GSSESGSSEGGPGSGGEPSESGSSGSSESGSSEGGP | 642 | GGTTCTTCCGAAAGCGGTTCTTCCGAGGGCGGTCCAGGTTCCGGTGGTGAACCATCTGAATCTGGTAGCTCAGGTTCTTCTGAAAGCGGTTCTTCTGAAGGTGGTCCA | 680 |
| LCW0401_042_GFP-N_C04.ab1 | GSEGSSGPGESSGESPGGSSGSESGSEGSSGPGESS | 643 | GGTAGCGAAGGTTCTTCCGGTCCTGGTGAGTCTTCAGGTGAATCTCCAGGTGGCTCTAGCGGTTCCGAGTCAGGTAGCGAAGGTTCTTCTGGTCCTGGCGAGTCCTCA | 681 |
| LCW0401_046_GFP-N_D04.ab1 | GSSESGSSEGGPGSSESGSSEGGPGSSESGSSEGGP | 644 | GGTTCCTCTGAAAGCGGTTCTTCCGAAGGCGGTCCAGGTTCTTCCGAAAGCGGTTCTTCTGAGGGCGGTCCAGGTTCCTCCGAAAGCGGTTCTTCTGAGGGTGGTCCA | 682 |
| LCW0401_047_GFP-N_E04.ab1 | GSGGEPSESGSSGESPGGSSGSESGESPGGSSGSES | 645 | GGTTCTGGTGGCGAACCTTCCGAGTCTGGTAGCTCAGGTGAATCTCCGGGTGGTTCTAGCGGTTCCGAGTCAGGTGAATCTCCGGGTGGTTCCAGCGGTTCTGAGTCA | 683 |
| LCW0401_051_GFP-N_F04.ab1 | GSGGEPSESGSSGSEGSSGPGESSGESPGGSSGSES | 646 | GGTTCTGGTGGCGAACCATCTGAGTCTGGTAGCTCAGGTAGCGAAGGTTCTTCCGGTCCAGGCGAGTCTTCAGGTGAATCTCCTGGTGGCTCCAGCGGTTCTGAGTCA | 684 |
| LCW0401_053_GFP-N_H04.ab1 | GESPGGSSGSESGESPGGSSGSESGESPGGSSGSES | 647 | GGTGAATCTCCTGGTGGTTCCAGCGGTTCCGAGTCAGGTGAATCTCCAGGTGGCTCTAGCGGTTCCGAGTCAGGTGAATCTCCTGGTGGTTCTAGCGGTTCTGAATCA | 685 |
| LCW0401_054_GFP-N_A05.ab1 | GSEGSSGPGESSGESGSSGPGESSGSGGEPSESGSS | 648 | GGTAGCGAAGGTTCTTCCGGTCCAGGTGAATCTTCAGGTAGCGAAGGTTCTTCTGGTCCTGGTGAATCCTCAGGTTCCGGTGGCGAACCATCTGAATCTGGTAGCTCA | 686 |
| LCW0401_059_GFP-N_D05.ab1 | GSGGEPSESGSSGSEGSSGPGESSGESPGGSSGSES | 649 | GGTTCTGGTGGCGAACCATCCGAATCTGGTAGCTCAGGTAGCGAAGGTTCTTCTGGTCCTGGCGAATCTTCAGGTGAATCTCCAGGTGGCTCTAGCGGTTCCGAATCA | 687 |
| LCW0401_060_GFP-N_E05.ab1 | GSGGEPSESGSSGSSESGSSEGGPGSGGEPSESGSS | 650 | GGTTCCGGTGGTGAACCGTCCGAATCTGGTAGCTCAGGTTCCTCTGAAAGCGGTTCTTCCGAGGGTGGTCCAGGTTCCGGTGGTGAACCTTCTGAGTCTGGTAGCTCA | 688 |
| LCW0401_061_GFP-N_F05.ab1 | GSSESGSSEGGPGSGGEPSESGSSGSEGSSGPGESS | 651 | GGTTCCTCTGAAAGCGGTTCTTCTGAGGGCGGTCCAGGTTCTGGTGGCGAACCATCTGAATCTGGTAGCTCAGGTAGCGAAGGTTCTTCCGGTCCGGGTGAATCTTCA | 689 |
| LCW0401_063_GFP-N_H05.ab1 | GSGGEPSESGSSGSEGSSGPGESSGSEGSSGPGESS | 652 | GGTTCTGGTGGTGAACCGTCCGAATCTGGTAGCTCAGGTAGCGAAGGTTCTTCTGGTCCTGGCGAGTCTTCAGGTAGCGAAGGTTCTTCTGGTCCTGGTGAATCTTCA | 690 |
| LCW0401_066_GFP-N_B06.ab1 | GSGGEPSESGSSGSSESGSSEGGPGSGGEPSESGSS | 653 | GGTTCTGGTGGCGAACCATCCGAGTCTGGTAGCTCAGGTTCTTCCGAAAGCGGTTCTTCCGAAGGCGGTCCAGGTTCTGGTGGTGAACCGTCCGAATCTGGTAGCTCA | 691 |
| LCW0401_067_GFP-N_C06.ab1 | GSGGEPSESGSSGESPGGSSGSESGESPGGSSGSES | 654 | GGTTCCGTGGCGAACCTTCCGAATCTGGTAGCTCAGGTGAATCTCCGGGTGGTTCTAGCGGTTCCGAATCAGGTGAATCTCCAGGTGGTTCTAGCGGTTCCGAATCA | 692 |
| LCW0401_069_GFP-N_D06.ab1 | GSGGEPSESGSSGSGGEPSESGSSGESPGGSSGSES | 655 | GGTTCCGGTGGTGAACCATCTGAGTCTGGTAGCTCAGGTTCCGGTGGCGAACCGTCCGAGTCTGGTAGCTCAGGTGAATCTCCGGGTGGTTCCAGCGGTTCCGAATCA | 693 |

TABLE 22-continued

DNA and Amino Acid Sequences for 36-mer motifs

| File name | Amino acid sequence | SEQ ID NO: | Nucleotide sequence | SEQ ID NO: |
|---|---|---|---|---|
| LCW0401_070_ GFP-N_E06.ab1 | GSEGSSGPGESSGSSESG SSEGGPGSEGSSGPGESS | 656 | GGTAGCGAAGGTTCTTCTGGTCCGGGCGAATCC TCAGGTTCCTCCGAAAGCGGTTCTTCCGAAGGT GGTCCAGGTAGCGAAGGTTCTTCCGGTCCTGGT GAATCTTCA | 694 |
| LCW0401_078_ GFP-N_F06.ab1 | GSSESGSSEGGPGESPGG SSGSESGESPGGSSGSES | 657 | GGTTCCTCTGAAAGCGGTTCTTCTGAAGGCGGT CCAGGTGAATCTCCGGGTGGCTCCAGCGGTTCT GAATCAGGTGAATCTCCTGGTGGCTCCAGCGGT TCCGAGTCA | 695 |
| LCW0401_079_ GFP-N_G06.ab1 | GSEGSSGPGESSGSEGSS GPGESSGSGGEPSESGSS | 658 | GGTAGCGAAGGTTCTTCTGGTCCAGGCGAGTCT TCAGGTAGCGAAGGTTCTTCCGGTCCTGGCGAG TCTTCAGGTTCCGGTGGCGAACCGTCCGAATCT GGTAGCTCA | 696 |

Example 2: Construction of XTEN_AE36 Segments

A codon library encoding XTEN sequences of 36 amino acid length was constructed. The XTEN sequence was designated XTEN_AE36. Its segments have the amino acid sequence [X]₃ where X is a 12mer peptide with the sequence: GSPAGSPTSTEE (SEQ ID NO: 30), GSE-PATSGSE TP (SEQ ID NO: 31), GTSESA TPESGP (SEQ ID NO: 32), or GTSTEPSEGSAP (SEQ ID NO: 33). The insert was obtained by annealing the following pairs of phosphorylated synthetic oligonucleotide pairs:

```
AE1for:
AGGTAGCCCDGCWGGYTCTCCDACYTCYACYGARGA
(SEQ ID NO: 697)

AE1rev:
ACCTTCYTCRGTRGARGTHGGAGARCCWGCHGGGCT
(SEQ ID NO: 698)

AE2for:
AGGTAGCGAACCKGCWACYTCYGGYTCTGARACYCC
(SEQ ID NO: 699)

AE2rev:
ACCTGGRGTYTCAGARCCRGARGTWGCMGGTTCGCT
(SEQ ID NO: 700)

AE3for:
AGGTACYTCTGAAAGCGCWACYCCKGARTCYGGYCC
(SEQ ID NO: 701)

AE3rev:
ACCTGGRCCRGAYTCMGGRGTWGCGCTTTCAGARGT
(SEQ ID NO: 7022)

AE4for:
AGGTACYTCTACYGAACCKTCYGARGGYAGCGCWCC
(SEQ ID NO: 703)

AE4rev:
ACCTGGWGCGCTRCCYTCRGAMGGTTCRGTAGARGT
(SEQ ID NO: 704)
```

We also annealed the phosphorylated oligonucleotide 3KpnIstopperFor: AGGTICGTCTTCACTCGAGGGTAC (SEQ ID NO: 619) and the non-phosphorylated oligonucleotide pr_3KpnIstopperRev: CCTCGAGTGAAGACGA (SEQ ID NO: 620). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0402 showed green fluorescence after induction which shows that the sequence of XTEN_AE36 had been ligated in frame with the GFP gene and most sequences of XTE-N_AE36 show good expression.

We screened 96 isolates from library LCW0402 for high level of fluorescence by stamping them onto agar plate containing IPTG. The same isolates were evaluated by PCR and 48 isolates were identified that contained segments with 36 amino acids as well as strong fluorescence. These isolates were sequenced and 37 clones were identified that contained correct XTEN_AE36 segments. The file names of the nucleotide and amino acid constructs for these segments are listed in Table 23.

TABLE 23

DNA and Amino Acid Sequences for 36-mer motifs

| File name | Amino acid sequence | SEQ ID NO: | Nucleotide sequence | SEQ ID NO: |
|---|---|---|---|---|
| LCW0402_002_ GFP-N_A07.ab1 | GSPAGSPTSTEEGTSE SATPESGPGTSTEPSE GSAP | 705 | GGTAGCCCGGCAGGCTCTCCGACCTCTACTGAGGAA GGTACTTCTGAAAGCGCAACCCCGGAGTCCGGCCCA GGTACCTCTACCGAACCGTCTGAGGGCAGCGCACCA | 742 |
| LCW0402_003_ GFP-N_B07.ab1 | GTSTEPSEGSAPGTST EPSEGSAPGTSTEPSE GSAP | 706 | GGTACTTCTACCGAACCGTCCGAAGGCAGCGCTCCA GGTACCTCTACTGAACCTTCCGAGGGCAGCGCTCCA GGTACCTCTACCGAACCTTCTGAAGGTAGCGCACCA | 743 |
| LCW0402_004_ | GTSTEPSEGSAPGTSE | 707 | GGTACCTCTACCGAACCGTCTGAAGGTAGCGCACCA | 744 |

TABLE 23-continued

DNA and Amino Acid Sequences for 36-mer motifs

| File name | Amino acid sequence | SEQ ID NO: | Nucleotide sequence | SEQ ID NO: |
|---|---|---|---|---|
| GFP-N_C07.ab1 | SATPESGPGTSESATPESGP | | GGTACCTCTGAAAGCGCAACTCCTGAGTCCGGTCCA GGTACTTCTGAAAGCGCAACCCCGGAGTCTGGCCCA | |
| LCW0402_005_GFP-N_D07.ab1 | GTSTEPSEGSAPGTSESATPESGPGTSESATPESGP | 708 | GGTACTTCTACTGAACCGTCTGAAGGTAGCGCACCA GGTACTTCTGAAAGCGCAACCCCGGAATCCGGCCCA GGTACCTCTGAAAGCGCAACCCCGGAGTCCGGCCCA | 745 |
| LCW0402_006_GFP-N_E07.ab1 | GSEPATSGSETPGTSESATPESGPGSPAGSPTSTEE | 709 | GGTAGCGAACCGGCAACCTCCGGCTCTGAAACCCCA GGTACCTCTGAAAGCGCTACTCCTGAATCCGGCCCA GGTAGCCCGGCAGGTTCTCCGACTTCCACTGAGGAA | 746 |
| LCW0402_008_GFP-N_F07.ab1 | GTSESATPESGPGSEPATSGSETPGTSTEPSEGSAP | 710 | GGTACTTCTGAAAGCGCAACCCCTGAATCCGGTCCA GGTAGCGAACCGGCTACTTCTGGCTCTGAGACTCCA GGTACTTCTACCGAACCGTCCGAAGGTAGCGCACCA | 747 |
| LCW0402_009_GFP-N_G07.ab1 | GSPAGSPTSTEEGSPAGSPTSTEEGSEPATSGSETP | 711 | GGTAGCCCGGCTGGCTCTCCAACCTCCACTGAGGAA GGTAGCCCGGCTGGCTCTCCAACCTCCACTGAAGAA GGTAGCGAACCGGCTACCTCCGGCTCTGAAACTCCA | 749 |
| LCW0402_011_GFP-N_A08.ab1 | GSPAGSPTSTEEGTSESATPESGPGTSTEPSEGSAP | 712 | GGTAGCCCGGCTGGCTCTCCTACCTCTACTGAGGAA GGTACTTCTGAAAGCGCTACTCCTGAGTCTGGTCCA GGTACCTCTACTGAACCGTCCGAAGGTAGCGCTCCA | 749 |
| LCW0402_012_GEP-N_B08.ab1 | GSPAGSPTSTEEGSPAGSPTSTEEGTSTEPSEGSAP | 713 | GGTAGCCCTGCTGGCTCTCCGACTTCTACTGAGGAA GGTAGCCCGGCTGGTTCTCCGACTTCTACTGAGGAA GGTACTTCTACCGAACCTTCCGAAGGTAGCGCTCCA | 750 |
| LCW0402_013_GFP-N_C08.ab1 | GTSESATPESGPGTSTEPSEGSAPGTSTEPSEGSAP | 714 | GGTACTTCTGAAAGCGCTACTCCGGAGTCCGGTCCA GGTACCTCTACCGAACCGTCCGAAGGCAGCGCTCCA GGTACTTCTACTGAACCTTCTGAGGGTAGCGCTCCA | 751 |
| LCW0402_014_GFP-N_D08.ab1 | GTSTEPSEGSAPGSPAGSPTSTEEGTSTEPSEGSAP | 715 | GGTACCTCTACCGAACCTTCCGAAGGTAGCGCTCCA GGTAGCCCGGCAGGTTCTCCTACTTCCACTGAGGAA GGTACTTCTACCGAACCTTCTGAGGGTAGCGCACCA | 752 |
| LCW0402_015_GFP-N_E08.ab1 | GSEPATSGSETPGSPAGSPTSTEEGTSESATPESGP | 716 | GGTAGCGAACCGGCTACTTCCGGCTCTGAGACTCCA GGTAGCCCTGCTGGCTCTCCGACCTCTACCGAAGAA GGTACCTCTGAAAGCGCTACCCCTGAGTCGGCCCA | 753 |
| LCW0402_016_GFP-N_F08.ab1 | GTSTEPSEGSAPGTSESATPESGPGTSESATPESGP | 717 | GGTACTTCTACCGAACCTTCCGAGGGCAGCGCACCA GGTACTTCTGAAAGCGCTACCCCTGAGTCCGGCCCA GGTACTTCTGAAAGCGCTACTCCTGAATCCGGTCCA | 754 |
| LCW0402_020_GFP-N_G08.ab1 | GTSTEPSEGSAPGSEPATSGSETPGSPAGSPTSTEE | 718 | GGTACTTCTACTGAACCGTCTGAAGGCAGCGCACCA GGTAGCGAACCGGCTACTTCCGGTTCTGAAACCCCA GGTAGCCCAGCAGGTTCTCCAACTTCTACTGAAGAA | 755 |
| LCW0402_023_GFP-N_A09.ab1 | GSPAGSPTSTEEGTSESATPESGPGSEPATSGSETP | 719 | GGTAGCCCTGCTGGCTCTCCAACCTCCACCGAAGAA GGTACCTCTGAAAGCGCAACCCCTGAATCCGGCCCA GGTAGCGAACCGGCAACCTCCGGTTCTGAAACCCCA | 756 |
| LCW0402_024_GFP-N_B09.ab1 | GTSESATPESGPGSPAGSPTSTEEGSPAGSPTSTEE | 720 | GGTACTTCTGAAAGCGCTACTCCTGAGTCCGGCCCA GGTAGCCCGGCTGGCTCTCCGACTTCCACCGAGGAA GGTAGCCCGGCTGGCTCTCCAACTTCTACTGAAGAA | 757 |
| LCW0402_025_GFP-N_C09.ab1 | GTSTEPSEGSAPGTSESATPESGPGTSTEPSEGSAP | 721 | GGTACCTCTACTGAACCTTCTGAGGGCAGCGCTCCA GGTACTTCTGAAAGCGCTACCCCGGAGTCCGGTCCA GGTACTTCTACTGAACCGTCCGAAGGTAGCGCACCA | 758 |
| LCW0402_026_GFP-N_D09.ab1 | GSPAGSPTSTEEGTSTEPSEGSAPGSEPATSGSETP | 722 | GGTAGCCCGGCAGGCTCTCCGACTTCCACCGAGGAA GGTACCTCTACTGAACCTTCTGAGGGTAGCGCTCCA GGTAGCGAACCGGCAACCTCTGGCTCTGAAACCCCA | 759 |
| LCW0402_027_GFP-N_E09.ab1 | GSPAGSPTSTEEGTSTEPSEGSAPGTSTEPSEGSAP | 723 | GGTAGCCCAGCAGGCTCTCCGACTTCCACTGAGGAA GGTACTTCTACTGAACCTTCCGAAGGCAGCGCTCCA GGTACCTCTACTGAACCTTCTGAGGGCAGCGCTCCA | 760 |
| LCW0402_032_GFP-N_H09.ab1 | GSEPATSGSETPGTSESATPESGPGSPAGSPTSTEE | 724 | GGTAGCGAACCTGCTACCTCCGGTTCTGAAACCCCA GGTACCTCTGAAAGCGCAACTCCGGAGTCTGGTCCA GGTAGCCCTGCAGGTTCTCCTACCTCCACTGAGGAA | 761 |
| LCW0402_034_GFP-N_A10.ab1 | GTSESATPESGPGTSTEPSEGSAPGTSTEPSEGSAP | 725 | GGTACCTCTGAAAGCGCTACTCCGGAGTCTGGCCCA GGTACCTCTACTGAACCGTCTGAGGGTAGCGCTCCA GGTACTTCTACTGAACCGTCCGAAGGTAGCGCACCA | 762 |

TABLE 23-continued

DNA and Amino Acid Sequences for 36-mer motifs

| File name | Amino acid sequence | SEQ ID NO: | Nucleotide sequence | SEQ ID NO: |
|---|---|---|---|---|
| LCW0402_036_GFP-N_C10.ab1 | GSPAGSPTSTEEGTSTEPSEGSAPGTSTEPSEGSAP | 726 | GGTAGCCCGGCTGGTTCTCCGACTTCCACCGAGGAAGGTACCTCTACTGAACCTTCTGAGGGTAGCGCTCCAGGTACCTCTACTGAACCTTCCGAAGGCAGCGCTCCA | 763 |
| LCW0402_039_GFP-N_E10.ab1 | GTSTEPSEGSAPGTSTEPSEGSAPGTSTEPSEGSAP | 727 | GGTACTTCTACCGAACCGTCCGAGGGCAGCGCTCCAGGTACTTCTACTGAACCTTCTGAAGGCAGCGCTCCAGGTACTTCTACTGAACCTTCCGAAGGTAGCGCACCA | 764 |
| LCW0402_040_GFP-N_F10.ab1 | GSEPATSGSETPGTSESATPESGPGTSTEPSEGSAP | 728 | GGTAGCGAACCTGCAACCTCTGGCTCTGAAACCCCAGGTACCTCTGAAAGCGCTACTCCTGAATCTGGCCCAGGTACTTCTACTGAACCGTCCGAGGGCAGCGCACCA | 76 |
| LCW0402_041_GFP-N_G10.ab1 | GTSTEPSEGSAPGSPAGSPTSTEEGTSTEPSEGSAP | 729 | GGTACTTCTACCGAACCGTCCGAGGGTAGCGCACCAGGTAGCCCAGCAGGTTCTCCTACCTCCACCGAGGAAGGTACTTCTACCGAACCGTCCGAGGGTAGCGCACCA | 766 |
| LCW0402_050_GFP-N_A11.ab1 | GSEPATSGSETPGTSESATPESGPGSEPATSGSETP | 730 | GGTAGCGAACCGGCAACCTCCGGCTCTGAAACTCCAGGTACTTCTGAAAGCGCTACTCCGGAATCCGGCCCAGGTAGCGAACCGGCTACTTCCGGCTCTGAAACCCCA | 767 |
| LCW0402_051_GFP-N_B11.ab1 | GSEPATSGSETPGTSESATPESGPGSEPATSGSETP | 731 | GGTAGCGAACCGGCAACTTCCGGCTCTGAAACCCCAGGTACTTCTGAAAGCGCTACTCCTGAGTCTGGCCCAGGTAGCGAACCTGCTACCTCTGGCTCTGAAACCCCA | 768 |
| LCW0402_059_GFP-N_E11.ab1 | GSEPATSGSETPGSEPATSGSETPGTSTEPSEGSAP | 732 | GGTAGCGAACCGGCAACCTCTGGCTCTGAAACTCCAGGTAGCGAACCTGCAACCTCCGGCTCTGAAACCCCAGGTACTTCTACTGAACCTTCTGAGGGCAGCGCACCA | 769 |
| LCW0402_060_GFP-N_F11.ab1 | GTSESATPESGPGSEPATSGSETPGSEPATSGSETP | 733 | GGTACTTCTGAAAGCGCTACCCCGGAATCTGGCCCAGGTAGCGAACCGGCTACTTCTGGTTCTGAAACCCCAGGTAGCGAACCGGCTACCTCCGGTTCTGAAACTCCA | 770 |
| LCW0402_061_GFP-N_G11.ab1 | GTSTEPSEGSAPGTSTEPSEGSAPGTSESATPESGP | 734 | GGTACCTCTACTGAACCTTCCGAAGGCAGCGCTCCAGGTACCTCTACCGAACCGTCCGAGGGCAGCGCACCAGGTACTTCTGAAAGCGCTAACCCCTGAATCCGGTCCA | 771 |
| LCW0402_065_GFP-N_A12.ab1 | GSEPATSGSETPGTSESATPESGPGTSESATPESGP | 735 | GGTAGCGAACCGGCAACCTCTGGCTCTGAAACCCCAGGTACCTCTGAAAGCGCTACTCCGGAATCTGGTCCAGGTACTTCTGAAAGCGCTACTCCGGAATCCGGTCCA | 772 |
| LCW0402_066_GFP-N_B12.ab1 | GSEPATSGSETPGSEPATSGSETPGTSTEPSEGSAP | 736 | GGTAGCGAACCTGCTACCTCCGGCTCTGAAACTCCAGGTAGCGAACCGGCTACTTCCGGTTCTGAAACTCCAGGTACCTCTACCGAACCTTCCGAAGGCAGCGCACCA | 773 |
| LCW0402_067_GFP-N_C12.ab1 | GSEPATSGSETPGTSTEPSEGSAPGSEPATSGSETP | 737 | GGTAGCGAACCTGCTACTTCTGGTTCTGAAACTCCAGGTACTTCTACCGAACCGTCCGAGGGTAGCGCTCCAGGTAGCGAACCTGCTACTTCTGGTTCTGAAACTCCA | 774 |
| LCW0402_069_GFP-N_D12.ab1 | GTSTEPSEGSAPGTSTEPSEGSAPGSEPATSGSETP | 738 | GGTACCTCTACCGAACCGTCCGAGGGTAGCGCACCAGGTACCTCTACTGAACCGTCTGAGGGTAGCGCTCCAGGTAGCGAACCGGCAACCTCCGGTTCTGAAACTCCA | 775 |
| LCW0402_073_GFP-N_F12.ab1 | GTSTEPSEGSAPGSEPATSGSETPGSPAGSPTSTEE | 739 | GGTACTTCTACTGAACCTTCCGAAGGTAGCGCTCCAGGTAGCGAACCTGCTACTTCTGGTTCTGAAACCCCAGGTAGCCCGGCTGGCTCTCCGACCTCCACCGAGGAA | 776 |
| LCW0402_074_GFP-N_G12.ab1 | GSEPATSGSETPGSPAGSPTSTEEGTSESATPESGP | 740 | GGTAGCGAACCGGCTACTTCCGGCTCTGAGACTCCAGGTAGCCCAGCTGGTTCTCCAACCTCTACTGAGGAAGGTACTTCTGAAAGCGCTACCCCTGAATCTGGTCCA | 777 |
| LCW0402_075_GFP-N_H12.ab1 | GTSESATPESGPGSEPATSGSETPGTSESATPESGP | 741 | GGTACCTCTGAAAGCGCAACTCCTGAGTCTGGCCCAGGTAGCGAACCTGCTACCTCCGGCTCTGAGACTCCAGGTACCTCTGAAAGCGCAACCCCGGAATCTGGTCCA | 778 |

Example 3: Construction of XTEN_AF36 Segments

A codon library encoding sequences of 36 amino acid length was constructed. The sequences were designated XTEN_AF36. Its segments have the amino acid sequence [X]3 where X is a 12mer peptide with the sequence: GST-SESPSGTAP (SEQ ID NO: 34), GTSTPESGSASP (SEQ ID NO: 35), GTSPSGESSTAP (SEQ ID NO: 36), or GSTSS-TAESPGP (SEQ ID NO: 37). The insert was obtained by annealing the following pairs of phosphorylated synthetic oligonucleotide pairs:

```
AF1for:
AGGTTCTACYAGCGAATCYCCKTCTGGYACYGCWCC
(SEQ ID NO: 779)
```

-continued

AF1rev:
ACCTGGWGCRGTRCCAGAMGGRGATTCGCTRGTAGA
(SEQ ID NO: 780)

AF2for:
AGGTACYTCTACYCCKGAAAGCGGYTCYGCWTCTCC
(SEQ ID NO: 781)

AF2rev:
ACCTGGAGAWGCRGARCCGCTTTCMGGRGTAGARGT
(SEQ ID NO: 782)

AF3for:
AGGTACYTCYCCKAGCGGYGAATCTTCTACYGCWCC
(SEQ ID NO: 783)

AF3rev:
ACCTGGWGCRGTAGAAGATTCRCCGCTMGGRGARGT
(SEQ ID NO: 784)

AF4for:
AGGTTCYACYAGCTCTACYGCWGAATCTCCKGGYCC
(SEQ ID NO: 785)

AF4rev:
ACCTGGRCCMGGAGATTCWGCRGTAGAGCTRGTRGA
(SEQ ID NO: 786)

We also annealed the phosphorylated oligonucleotide 3KpnIstopperFor: AGGTCGTCTTCACTCGAGGGTAC (SEQ ID NO: 619) and the non-phosphorylated oligonucleotide pr_3KpnIstopperRev: CCTCGAGTGAAGACGA (SEQ ID NO: 620). The annealed oligonucleotide pairs were ligated, which resulted in a mixture of products with varying length that represents the varying number of 12mer repeats ligated to one BbsI/KpnI segment The products corresponding to the length of 36 amino acids were isolated from the mixture by preparative agarose gel electrophoresis and ligated into the BsaI/KpnI digested stuffer vector pCW0359. Most of the clones in the resulting library designated LCW0403 showed green fluorescence after induction which shows that the sequence of XTEN_AF36 had been ligated in frame with the GFP gene and most sequences of XTEN_AF36 show good expression.

We screened 96 isolates from library LCW0403 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AF36 segments. The file names of the nucleotide and amino acid constructs for these segments are listed in Table 24.

TABLE 24

DNA and Amino Acid Sequences for 36-mer motifs

| File name | Amino acid sequence | SED ID NO: | Nucleotide sequence | SEQ ID NO: |
|---|---|---|---|---|
| LCW0403_004_GFP-N_A01.ab1 | GTSTPESGSASPGTSPSGESSTAPGTSPSGESSTAP | 787 | GGTACTTCTACTCCGGAAAGCGGTTCCGCATCTCCAG GTACTTCTCCTAGCGGTGAATCTTCTACTGCTCCAGG TACCTCTCCTAGCGGCGAATCTTCTACTGCTCCA | 831 |
| LCW0403_005_GFP-N_B01.ab1 | GTSPSGESSTAPGSTSSTAESPGPGTSPSGESSTAP | 788 | GGTACTTCTCCGAGCGGTGAATCTTCTACCGCACCAG GTTCTACTAGCTCTACCGCTGAATCTCCGGGCCCAGG TACTTCTCCGAGCGGTGAATCTTCTACTGCTCCA | 832 |
| LCW0403_006_GFP-N_C01.ab1 | GSTSSTAESPGPGTSPSGESSTAPGTSTPESGSASP | 789 | GGTTCCACCAGCTCTACTGCTGAATCTCCTGGTCCAG GTACCTCTCCTAGCGGTGAATCTTCTACTGCTCCAGG TACTTCTACTCCTGAAAGCGGCTCTGCTTCTCCA | 833 |
| LCW0403_007_GFP-N_D01.ab1 | GSTSSTAESPGPGTSSTAESPGPGTSPSGESSTAP | 790 | GGTTCTACCAGCTCTACTGCAGAATCTCCTGGCCCAG GTTCCACCAGCTCTACCGCAGAATCTCCGGGTCCAGG TACTTCCCCTAGCGGTGAATCTTCTACCGCACCA | 834 |
| LCW0403_008_GFP-N_E01.ab1 | GSTSSTAESPGPGTSPSGESSTAPGTSTPESGSASP | 791 | GGTTCTACTAGCTCTACTGCTGAATCTCCTGGCCCAG GTACTTCTCCTAGCGGTGAATCTTCTACCGCTCCAGG TACCTCTACTCCGGAAAGCGGTTCTGCATCTCCA | 835 |
| LCW0403_010_GFP-N_F01.ab1 | GSTSSTAESPGPGTSTPESGSASPGSTSESPSGTAP | 792 | GGTTCTACCAGCTCTACCGCAGAATCTCCTGGTCCAG GTACCTCTACTCCGGAAAGCGGCTCTGCATCTCCAGG TTCTACTAGCGAATCTCCTTCTGGCACTGCACCA | 836 |
| LCW0403_011_GFP-N_G01.ab1 | GSTSSTAESPGPGTSTPESGSASPGTSTPESGSASP | 793 | GGTTCTACTAGCTCTACTGCAGAATCTCCTGGCCCAG GTACCTCTACTCCGGAAAGCGGCTCTGCATCTCCAGG TACTTCTACCCCTGAAAGCGGTTCTGCATCTCCA | 837 |
| LCW0403_012_GFP-N_H01.ab1 | GSTSESPSGTAPGTSPSGESSTAPGSTSESPSGTAP | 794 | GGTTCTACCAGCGAATCTCCTTCTGGCACCGCTCCAG GTACCTCTCCTAGCGGCGAATCTTCTACCGCTCCAGG TTCTACTAGCGAATCTCCTTCTGGCACTGCACCA | 838 |
| LCW0403_013_GFP-N_A02.ab1 | GSTSSTAESPGPGTSSTAESPGPGTSPSGESSTAP | 795 | GGTTCCACCAGCTCTACTGCAGAATCTCCGGGCCCA GGTTCTACTAGCTCTACTGCAGAATCTCCGGGTCCAG GTACTTCTCCTAGCGGCGAATCTTCTACCGCTCCA | 839 |
| LCW0403_014_GFP-N_B02.ab1 | GSTSSTAESPGPGTSTPESGSASPGSTSESPSGTAP | 796 | GGTTCCACTAGCTCTACTGCAGAATCTCCTGGCCCAG GTACCTCTACCCCTGAAAGCGGCTCTGCATCTCCAG GTTCTACCAGCGAATCCCCGTCTGGCACCGCACCA | 840 |
| LCW0403_015_GFP-N_C02.ab1 | GSTSSTAESPGPGTSSTAESPGPGTSPSGESSTAP | 797 | GGTTCTACTAGCTCTACTGCTGAATCTCCGGGTCCAG GTTCTACCAGCTCTACTGCTGAATCTCCTGGTCCAGG TACCTCCCCGAGCGGTGAATCTTCTACTGCACCA | 841 |

TABLE 24-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_017_GFP-N_D02.ab1 | GSTSSTAESPGPGSTSESPSGTAPGSTSSTAESPGP | 798 | GGTTCTACCAGCTCTACCGCTGAATCTCCTGGCCCAGGTTCTACCAGCGAATCCCCGTCTGGCACCGCACCAGGTTCTACTAGCTCTACCGCTGAATCTCCGGGTCCA | 842 |
| LCW0403_018_GFP-N_E02.ab1 | GSTSSTAESPGPGSTSSTAESPGPGSTSSTAESPGP | 799 | GGTTCTACCAGCTCTACCGCAGAATCTCCTGGCCCAGGTTCCACTAGCTCTACCGCTGAATCTCCTGGTCCAGTTCTACTAGCTCTACCGCTGAATCTCCTGGTCCA | 843 |
| LCW0403_019_GFP-N_F02.ab1 | GSTSESPSGTAPGSTSSTAESPGPGSTSSTAESPGP | 800 | GGTTCTACTAGCGAATCCCCTTCTGGTACTGCTCCAGGTTCCACTAGCTCTACCGCTGAATCTCCTGGCCCAGGTTCCACTAGCTCTACTGCAGAATCTCCTGGTCCA | 844 |
| LCW0403_023_GFP-N_H02.ab1 | GSTSESPSGTAPGSTSESPSGTAPGSTSESPSGTAP | 801 | GGTTCTACTAGCGAATCTCCTTCTGGTACCGCTCCAGGTTCTACCAGCGAATCCCCGTCTGGTACTGCTCCAGGTTCTACCAGCGAATCTCCTTCTGGTACTGCACCA | 845 |
| LCW0403_024_GFP-N_A03.ab1 | GSTSSTAESPGPGSTSSTAESPGPGSTSSTAESPGP | 802 | GGTTCCACCAGCTCTACTGCTGAATCTCCTGGCCCAGGTTCTACCAGCTCTACTGCTGAATCTCCGGGCCCAGGTTCCACCAGCTCTACCGCTGAATCTCCGGGTCCA | 846 |
| LCW0403_025_GFP-N_B03.ab1 | GSTSSTAESPGPGSTSSTAESPGPGTSPSGESSTAP | 803 | GGTTCCACTAGCTCTACCGCAGAATCTCCTGGTCCAGGTTCTACTAGCTCTACTGCTGAATCTCCGGGTCCAGGTACCTCCCCTAGCGGCGAATCTTCTACCGCTCCA | 847 |
| LCW0403_028_GFP-N_D03.ab1 | GSSPSASTGTGPGSSTPSGATGSPGSSTPSGATGSP | 804 | GGTTCTAGCCCTTCTGCTTCCACCGGTACCGGCCCAGGTAGCTCTACTCCGTCTGGTGCAACTGGCTCTCCAGGTAGCTCTACTCCGTCTGGTGCAACCGGCTCCCCA | 848 |
| LCW0403_029_GFP-N_E03.ab1 | GTSPSGESSTAPGTSTPESGSASPGSSTAESPGP | 805 | GGTACTTCCCCTAGCGGTGAATCTTCTACTGCTCCAGGTACCTCTACTCCGGAAAGCGGCTCCGCATCTCCAGGTTCTACTAGCTCTACTGCTGAATCTCCTGGTCCA | 849 |
| LCW0403_030_GFP-N_F03.ab1 | GSTSSTAESPGPGSTSSTAESPGPGTSTPESGSASP | 806 | GGTTCTACTAGCTCTACCGCTGAATCTCCGGGTCCAGGTTCTACCAGCTCTACTGCAGAATCTCCTGGCCCAGGTACTTCTACTCCGGAAAGCGGTTCCGCTTCTCCA | 850 |
| LCW0403_031_GFP-N_G03.ab1 | GTSPSGESSTAPGSTSSTAESPGPGTSTPESGSASP | 807 | GGTACTTCTCCTAGCGGTGAATCTTCTACCGCTCCAGGTTCTACCAGCTCTACTGCTGAATCTCCTGGCCCAGGTACTTCTACCCCGGAAAGCGGCTCCGCTTCTCCA | 851 |
| LCW0403_033_GFP-N_H03.ab1 | GSTSESPSGTAPGSTSSTAESPGPGSTSSTAESPGP | 808 | GGTTCTACTAGCGAATCCCCTTCTGGTACTGCACCAGGTTCTACCAGCTCTACTGCTGAATCTCCGGGCCCAGGTTCCACCAGCTCTACCGCAGAATCTCCTGGTCCA | 852 |
| LCW0403_035_GFP-N_A04.ab1 | GSTSSTAESPGPGSTSESPSGTAPGSTSSTAESPGP | 809 | GGTTCCACCAGCTCTACCGCTGAATCTCCGGGCCCAGGTTCTACCAGCGAATCCCCTTCTGGCACTGCACCAGGTTCTACTAGCTCTACCGCAGAATCTCCGGGCCCA | 853 |
| LCW0403_036_GFP-N_B04.ab1 | GSTSSTAESPGPGTSPSGESSTAPGTSTPESGSASP | 810 | GGTTCTACCAGCTCTACTGCTGAATCTCCGGGTCCAGGTACTTCCCCGAGCGGTGAATCTTCTACTGCACCAGGTACTTCTACTCCGGAAAGCGGTTCCGCTTCTCCA | 854 |
| LCW0403_039_GFP-N_C04.ab1 | GSTSESPSGTAPGSTSESPSGTAPGTSPSGESSTAP | 811 | GGTTCTACCAGCGAATCTCCTTCTGGCACCGCTCCAGGTTCTACTAGCGAATCCCCGTCTGGTACCGCACCAGGTACTTCTCCTAGCGGCGAATCTTCTACCGCACCA | 855 |
| LCW0403_041_GFP-N_D04.ab1 | GSTSESPSGTAPGSTSESPSGTAPGTSTPESGSASP | 812 | GGTTCTACCAGCGAATCCCCTTCTGGTACTGCTCCAGGTTCTACCAGCGAATCCCCTTCTGGCACCGCACCAGGTACTTCTACCCCTGAAAGCGGCTCCGCTTCTCCA | 856 |
| LCW0403_044_GFP-N_E04.ab1 | GTSTPESGSASPGSTSSTAESPGPGSTSSTAESPGP | 813 | GGTACCTCTACTCCTGAAAGCGGTTCTGCATCTCCAGGTTCCACTAGCTCTACCGCAGAATCTCCGGGCCCAGGTTCTACTAGCTCTACTGCTGAATCTCCTGGCCCA | 857 |
| LCW0403_046_GFP-N_F04.ab1 | GSTSESPSGTAPGSTSESPSGTAPGTSPSGESSTAP | 814 | GGTTCTACCAGCGAATCCCCTTCTGGCACTGCACCAGGTTCTACCAGCGAATCCCCTTCTGGTACCGCACCAGGTACTTCTCCGAGCGGCGAATCTTCTACTGCTCCA | 858 |
| LCW0403_047_GFP-N_G04.ab1 | GSTSSTAESPGPGSTSSTAESPGPGSTSESPSGTAP | 815 | GGTTCTACTAGCTCTACCGCTGAATCTCCTGGCCCAGGTTCTACTAGCTCTACCGCTGAATCTCCGGGCCCAGGTTCTACTAGCGAATCCCTTCTGGTACCGCTCCA | 859 |
| LCW0403_049_GFP-N_H04.ab1 | GSTSSTAESPGPGSTSSTAESPGPGTSTPESGSASP | 816 | GGTTCCACCAGCTCTACTGCAGAATCTCCTGGCCCAGGTTCTACTAGCTCTACCGCAGAATCTCCTGGTCCAGGTACCTCTACTCCTGAAAGCGGTTCCGCATCTCCA | 860 |

TABLE 24-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_051_GFP-N_A05.ab1 | GSTSSTAESPGPGSTSSTAESPGPGSTSESPSGTAP | 817 | GGTTCTACTAGCTCTACTGCTGAATCTCCGGGCCCAGGTTCTACTAGCTCTACCGCTGAATCTCCGGGTCCAGGTTCTACTAGCGAATCTCCTTCTGGTACCGCTCCA | 861 |
| LCW0403_053_GFP-N_B05.ab1 | GTSPSGESSTAPGSTSESPSGTAPGSTSSTAESPGP | 818 | GGTACCTCCCCGAGCGGTGAATCTTCTACTGCACCAGGTTCTACTAGCGAATCCCCTTCTGGTACTGCTCCAGGTTCCACCAGCTCTACTGCAGAATCTCCGGGTCCA | 862 |
| LCW0403_054_GFP-N_C05.ab1 | GSTSESPSGTAPGTSPSGESSTAPGSTSSTAESPGP | 819 | GGTTCTACTAGCGAATCCCCGTCTGGTACTGCTCCAGGTACTTCCCCTAGCGGTGAATCTTCTACTGCTCCAGGTTCTACCAGCTCTACCGCAGAATCTCCGGGTCCA | 863 |
| LCW0403_057_GFP-N_D05.ab1 | GSTSSTAESPGPGSTSESPSGTAPGTSPSGESSTAP | 820 | GGTTCTACCAGCTCTACCGCTGAATCTCCTGGCCCAGGTTCTACTAGCGAATCTCCGTCTGGCACCGCACCAGGTACTTCCCCTAGCGGTGAATCTTCTACTGCACCA | 864 |
| LCW0403_058_GFP-N_E05.ab1 | GSTSESPSGTAPGSTSESPSGTAPGTSTPESGSASP | 821 | GGTTCTACTAGCGAATCTCCTTCTGGCACTGCACCAGGTTCTACCAGCGAATCTCCGTCTGGCACTGCACCAGGTACCTCTACCCCTGAAAGCGGTTCCGCTTCTCCA | 865 |
| LCW0403_060_GFP-N_F05.ab1 | GTSTPESGSASPGSTSESPSGTAPGSTSSTAESPGP | 822 | GGTACCTCTACTCCGGAAAGCGGTTCCGCATCTCCAGGTTCTACCAGCGAATCCCCGTCTGGCACCGCACCAGGTTCTACTAGCTCTACTGCTGAATCTCCGGGCCCA | 866 |
| LCW0403_063_GFP-N_G05.ab1 | GSTSSTAESPGPGTSPSGESSTAPGTSPSGESSTAP | 823 | GGTTCTACTAGCTCTACTGCAGAATCTCCGGGCCCAGGTACCTCTCCTAGCGGTGAATCTTCTACCGCTCCAGGTACTTCTCCGAGCGGTGAATCTTCTACCGCTCCA | 867 |
| LCW0403_064_GFP-N_H05.ab1 | GTSPSGESSTAPGTSPSGESSTAPGTSPSGESSTAP | 824 | GGTACCTCCCCTAGCGGCGAATCTTCTACTGCTCCAGGTACCTCTCCTAGCGGCGAATCTTCTACCGCTCCAGGTACCTCCCCTAGCGGTGAATCTTCTACCGCACCA | 868 |
| LCW0403_065_GFP-N_A06.ab1 | GSTSSTAESPGPGTSTPESGSASPGSTSESPSGTAP | 825 | GGTTCCACTAGCTCTACTGCTGAATCTCCTGGCCCAGGTACTTCTACTCCGGAAAGCGGTTCCGCTTCTCCAGGTTCTACTAGCGAATCTCCGTCTGGCACCGCACCA | 869 |
| LCW0403_066_GFP-N_B06.ab1 | GSTSESPSGTAPGTSPSGESSTAPGSTSESPSGTAP | 826 | GGTTCTACTAGCGAATCTCCGTCTGGCACTGCTCCAGGTACTTCTCCTAGCGGTGAATCTTCTACCGCTCCAGGTACTTCCCCTAGCGGCGAATCTTCTACCGCTCCA | 870 |
| LCW0403_067_GFP-N_C06.ab1 | GSTSESPSGTAPGTSTPESGSASPGSTSSTAESPGP | 827 | GGTTCTACTAGCGAATCTCCTTCTGGTACCGCTCCAGGTACTTCTACCCCTGAAAGCGGCTCCGCTTCTCCAGGTTCCACTAGCTCTACCGCTGAATCTCCGGGTCCA | 871 |
| LCW0403_068_GFP-N_D06.ab1 | GSTSSTAESPGPGSTSSTAESPGPGSTSESPSGTAP | 828 | GGTTCCACTAGCTCTACTGCTGAATCTCCTGGCCCAGGTTCTACCAGCTCTACCGCTGAATCTCCTGGCCCAGGTTCTACCAGCGAATCTCCGTCTGGCACCGCACCA | 872 |
| LCW0403_069_GFP-N_E06.ab1 | GSTSESPSGTAPGTSTPESGSASPGTSTPESGSASP | 829 | GGTTCTACTAGCGAATCCCCGTCTGGTACCGCACCAGGTACTTCTACCCCGGAAAGCGGCTCTGCTTCTCCAGGTACTTCTACCCCGGAAAGCGGCTCCGCATCTCCA | 873 |
| LCW0403_070_GFP-N_F06.ab1 | GSTSESPSGTAPGTSTPESGSASPGTSTPESGSASP | 830 | GGTTCTACTAGCGAATCCCCGTCTGGTACTGCTCCAGGTACTTCTACTCCTGAAAGCGGTTCCGCTTCTCCAGGTACCTCTACTCCGGAAAGCGGTTCTGCATCTCCA | 874 |

Example 4: Construction of XTEN_AG36 Segments

A codon library encoding sequences of 36 amino acid length was constructed. The sequences were designated XTEN-AG36. Its segments have the amino acid sequence [X]₃ where X is a 12mer peptide with the sequence: GTPGS-GTASSSP (SEQ ID NO: 38), GSSTPSGATGSP (SEQ ID NO: 39), GSSPSASTGTGP (SEQ ID NO: 40), or GASPGTSSTGSP (SEQ ID NO: 41). The insert was obtained by annealing the following pairs of phosphorylated synthetic oligonucleotide pairs:

AG1for:
AGGTACYCCKGGYAGCGGTACYGCWTCTTCYTCTCC
(SEQ ID NO: 875)

AG1rev:
ACCTGGAGARGAAGAWGCRGTACCGCTRCCMGGRGT
(SEQ ID NO: 876)

AG2for:
AGGTAGCTCTACYCCKTCTGGTGCWACYGGYTCYCC
(SEQ ID NO: 877)

AG2rev:
ACCTGGRGARCCRGTWGCACCAGAMGGRGTAGAGCT
(SEQ ID NO: 878)

-continued

AG3for:
AGGTTCTAGCCCKTCTGCWTCYACYGGTACYGGYCC
(SEQ ID NO: 879)

AG3rev:
ACCTGGRCCRGTACCRGTRGAWGCAGAMGGGCTAGA
(SEQ ID NO: 880)

AG4for:
AGGTGCWTCYCCKGGYACYAGCTCTACYGGTTCTCC
(SEQ ID NO: 881)

AG4rev:
ACCTGGAGAACCRGTAGAGCTRGTRCCMGGRGAWGC
(SEQ ID NO: 882)

We also annealed the phosphorylated oligonucleotide 3KpnIlstopperFor: AGGTCGTCTTCACTCGAGGGTAC (SEQ ID NO: 619) and the non-phosphorylated oligonucleotide pr_3KpnIstopperRev: CCTCGAGTGAAGACGA (SEQ ID NO: 620). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0404 showed green fluorescence after induction which shows that the sequence of XTEN_AG36 had been ligated in frame with the GFP gene and most sequences of XTEN_AG36 show good expression.

We screened 96 isolates from library LCW0404 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AG36 segments. The file names of the nucleotide and amino acid constructs and the sequences for these segments are listed in Table 25.

TABLE 25

DNA and Amino Acid Sequences for 36-mer motifs

| File name | Amino acid sequence | SEQ ID NO: | Nucleotide sequence | SEQ ID NO: |
| --- | --- | --- | --- | --- |
| LCW0404_001_ GFP-N_A07.ab1 | GASPGTSSTGSPGTPG SGTASSSPGSSTPSGA TGSP | 883 | GGTGCATCCCCGGGCACTAGCTCTACCGGTTCTCCA GGTACTCCTGGTAGCGGTACTGCTTCTTCTTCTCCAG GTAGCTCTACTCCTTCTGGTGCTACTGGTTCTCCA | 927 |
| LCW0404_003_ GFP-N_B07.ab1 | GSSTPSGATGSPGSSP SASTGTGPGSSTPSGA TGSP | 884 | GGTAGCTCTACCCCTTCTGGTGCTACCGGCTCTCCAG GTTCTAGCCCGTCTGCTTCTACCGGTACCGGTCCAGG TAGCTCTACCCCTTCTGGTGCTACTGGTTCTCCA | 928 |
| LCW0404_006_ GFP-N_C07.ab1 | GASPGTSSTGSPGSSP SASTGTGPGSSTPSGA TGSP | 885 | GGTGCATCTCCGGGTACTAGCTCTACCGGTTCTCCAG GTTCTAGCCCTTCTGCTTCCACTGGTACCGGCCCAGG TAGCTCTACCCCGTCTGGTGCTACTGGTTCCCCA | 929 |
| LCW0404_007_ GFP-N_D07.ab1 | GTPGSGTASSSPGSST PSGATGSPGASPGTSS TGSP | 886 | GGTACTCCGGGCAGCGGTACTGCTTCTTCCTCTCCAG GTAGCTCTACCCCTTCTGGTGCAACTGGTTCCCCAGG TGCATCCCCTGGTACTAGCTCTACCGGTTCTCCA | 930 |
| LCW0404_009_ GFP-N_E07.ab1 | GTPGSGTASSSPGASP GTSSTGSPGSRPSAST GTGP | 887 | GGTACCCCTGGCAGCGGTACTGCTTCTTCTTCTCCAG GTGCTTCCCCTGGTACCAGCTCTACCGGTTCTCCAGG TTCTAGACCTTCTGCATCCACCGGTACTGGTCCA | 931 |
| LCW0404_011_ GFP-N_F07.ab1 | GASPGTSSTGSPGSST PSGATGSPGASPGTSS TGSP | 888 | GGTGCATCTCCTGGTACCAGCTCTACCGGTTCTCCAG GTAGCTCTACTCCTTCTGGTGCTACTGGTCTCTCCAGG TGCTTCCCCGGGTACCAGCTCTACCGGTTCTCCA | 932 |
| LCW0404_012_ GFP-N_G07.ab1 | GTPGSGTASSSPGSST PSGATGSPGSSTPSGA TGSP | 889 | GGTACCCCGGGCAGCGGTACCGCATCTTCCTCTCCA GGTAGCTCTACCCCGTCTGGTGCTACCGGTTCCCAG GTAGCTCTACCCCGTCTGGTGCAACCGGCTCCCCA | 933 |
| LCW0404_014_ GFP-N_H07.ab1 | GASPGTSSTGSPGASP GTSSTGSPGASPGTSS TGSP | 890 | GGTGCATCTCCGGGCACTAGCTCTACTGGTTCTCCAG GTGCATCCCCTGGCACTAGCTCTACTGGTTCTCCAGG TGCTTCTCCTGGTACCAGCTCTACTGGTTCTCCA | 934 |
| LCW0404_015_ GFP-N_A08.ab1 | GSSTPSGATGSPGSSP SASTGTGPGASPGTSS TGSP | 891 | GGTAGCTCTACTCCGTCTGGTGCAACCGGCTCCCCA GGTTCTAGCCCGTCTGCTTCCACTGGTACTGGCCCAG GTGCTTCCCCGGGCACCAGCTCTACTGGTTCTCCA | 935 |
| LCW0404_016_ GFP-N_B08.ab1 | GSSTPSGATGSPGSST PSGATGSPGTPGSGTA SSSP | 892 | GGTAGCTCTACTCCTTCTGGTGCTACCGGTTCCCAG GTAGCTCTACTCCTTCTGGTGCTACTGGTTCCCCAGG TACTCCGGGCAGCGGTACTGCTTCTTCCTCTCCA | 936 |
| LCW0404_017_ GFP-N_C08.ab1 | GSSTPSGATGSPGSST PSGATGSPGASPGTSS TGSP | 893 | GGTAGCTCTACTCCGTCTGGTGCAACCGGTTCCCAG GTAGCTCTACTCCTTCTGGTGCTACTGGCTCCCAGG TGCATCCCCTGGCACCAGCTCTACCGGTTCTCCA | 937 |
| LCW0404_018_ GFP-N_D08.ab1 | GTPGSGTASSSPGSSP SASTGTGPGSSTPSGA TGSP | 894 | GGTACTCCTGGTAGCGGTACCGCATCTTCCTCTCCAG GTTCTAGCCCCTTCTGCATCTACCGGTACCGGTCCAGG TAGCTCTACTCCTTCTGGTGCTACTGGCTCTCCA | 938 |

TABLE 25-continued

DNA and Amino Acid Sequences for 36-mer motifs

| File name | Amino acid sequence | SEQ ID NO: | Nucleotide sequence | SEQ ID NO: |
|---|---|---|---|---|
| LCW0404_023_ GFP-N_F08.ab1 | GASPGTSSTGSPGSSP SASTGTGPGTPGSGTA SSSP | 895 | GGTGCTTCCCCGGGCACTAGCTCTACCGGTTCTCCAG GTTCTAGCCCTTCTGCATCTACTGGTACTGGCCCAGG TACTCCGGGCAGCGGTACTGCTTCTTCCTCTCCA | 939 |
| LCW0404_025_ GFP-N_G08.ab1 | GSSTPSGATGSPGSST PSGATGSPGASPGTSS TGSP | 896 | GGTAGCTCTACTCCGTCTGGTGCTACCGGCTCTCCAG GTAGCTCTACCCCTTCTGGTGCAACCGGCTCCCCAGG TGCTTCTCCGGGTACCAGCTCTACTGGTTCTCCA | 940 |
| LCW0404_029_ GFP-N_A09.ab1 | GTPGSGTASSSPGSST PSGATGSPGSSPSAST GTGP | 897 | GGTACCCCTGGCAGCGGTACCGCTTCTTCCTCTCCAG GTAGCTCTACCCCGTCTGGTGCTACTGGCTCTCCAGG TTCTAGCCCGTCTGCATCTACCGGTACCGGCCCA | 941 |
| LCW0404_030_ GFP-N_B09.ab1 | GSSTPSGATGSPGTPG SGTASSSPGTPGSGTA SSSP | 898 | GGTAGCTCTACTCCTTCTGGTGCAACCGGCTCCCCAG GTACCCCGGGCAGCGGTACCGCATCTTCCTCTCCAG GTACTCCGGGTAGCGGTACTGCTTCTTCTTCTCCA | 942 |
| LCW0404_031_ GFP-N_C09.ab1 | GTPGSGTASSSPGSST PSGATGSPGASPGTSS TGSP | 899 | GGTACCCGGGTAGCGGTACTGCTTCTTCCTCTCCAG GTAGCTCTACCCCTTCTGGTGCAACCGGCTCTCCAGG TGCTTCTCCGGGCACCAGCTCTACCGGTTCTCCA | 943 |
| LCW0404_034_ GFP-N_D09.ab1 | GSSTPSGATGSPGSST PSGATGSPGASPGTSS TGSP | 900 | GGTAGCTCTACCCCGTCTGGTGCTACCGGCTCTCCAG GTAGCTCTACCCCGTCTGGTGCAACCGGCTCCCCAG GTGCATCCCCGGGTACTAGCTCTACCGGTTCTCCA | 944 |
| LCW0404_035_ GFP-N_E09.ab1 | GASPGTSSTGSPGTPG SGTASSSPGSSTPSGA TGSP | 901 | GGTGCTTCTCCGGGCACCAGCTCTACTGGTTCTCCAG GTACCCCGGGCAGCGGTACCGCATCTTCTTCTCCAG GTAGCTCTACTCCTTCTGGTGCAACTGGTTCTCCA | 945 |
| LCW0404_036_ GFP-N_F09.ab1 | GSSPSASTGTGPGSST PSGATGSPGTPGSGTA SSSP | 902 | GGTTCTAGCCCGTCTGCTTCCACCGGTACTGGCCCAG GTAGCTCTACCCCGTCTGGTGCAACTGGTTCCCCAGG TACCCCTGGTAGCGGTACCGCTTCTTCTTCTCCA | 946 |
| LCW0404_037_ GFP-N_G09.ab1 | GASPGTSSTGSPGSSP SASTGTGPGSSTPSGA TGSP | 903 | GGTGCTTCTCCGGGCACCAGCTCTACTGGTTCTCCAG GTTCTAGCCCTTCTGCATCCACCGGTACCGGTCCAGG TAGCTCTACCCCTTCTGGTGCAACCGGCTCTCCA | 947 |
| LCW0404_040_ GFP-N_H09.ab1 | GASPGTSSTGSPGSST PSGATGSPGSSTPSGA TGSP | 904 | GGTGCATCCCCGGGCACCAGCTCTACCGGTTCTCCA GGTAGCTCTACCCCGTCTGGTGCTACCGGCTCTCCAG GTAGCTCTACCCCGTCTGGTGCTACTGGCTCTCCA | 948 |
| LCW0404_041_ GFP-N_A10.ab1 | GTPGSGTASSSPGSST PSGATGSPGTPGSGTA SSSP | 905 | GGTACCCCTGGTAGCGGTACTGCTTCTTCCTCTCCAG GTAGCTCTACTCCGTCTGGTGCTACCGGTTCTCCAGG TACCCCGGGTAGCGGTACCGCATCTTCTTCTCCA | 949 |
| LCW0404_043_ GFP-N_C10.ab1 | GSSPSASTGTGPGSST PSGATGSPGSSTPSGA TGSP | 906 | GGTTCTAGCCCTTCTGCTTCCACCGGTACTGGCCCAG GTAGCTCTACCCCTTCTGGTGCTACCGGCTCCCCAGG TAGCTCTACTCCTTCTGGTGCAACTGGCTCTCCA | 950 |
| LCW0404_045_ GFP-N_D10.ab1 | GASPGTSSTGSPGSSP SASTGTGPGSSPSAST GTGP | 907 | GGTGCTTCTCCTGGCACCAGCTCTACTGGTTCTCCAG GTTCTAGCCCTTCTGCTTCTACCGGTACTGGTCCAGG TTCTAGCCCTTCTGCATCCACTGGTACTGGTCCA | 951 |
| LCW0404_047_ GFP-N_F10.ab1 | GTPGSGTASSSPGASP GTSSTGSPGASPGTSS TGSP | 908 | GGTACTCCTGGCAGCGGTACCGCTTCTTCTTCTCCAG GTGCTTCTCCTGGTACTAGCTCTACTGGTTCTCCAGG TGCTTCTCCGGGCACTAGCTCTACTGGTTCTCCA | 952 |
| LCW0404_048_ GFP-N_G10.ab1 | GSSTPSGATGSPGASP GTSSTGSPGSSTPSGA TGSP | 909 | GGTAGCTCTACCCCGTCTGGTGCTACCGGTTCCCCAG GTGCTTCTCCTGGTACTAGCTCTACCGGTTCTCCAGG TAGCTCTACCCCGTCTGGTGCTACTGGCTCTCCA | 953 |
| LCW0404_049_ GFP-N_H10.ab1 | GSSTPSGATGSPGTPG SGTASSSPGSSTPSGA TGSP | 910 | GGTAGCTCTACCCCGTCTGGTGCTACTGGTTCTCCAG GTACTCCGGGCAGCGGTACTGCTTCTTCCTCCAGG TAGCTCTACCCCTTCTGGTGCTACTGGCTCTCCA | 954 |
| LCW0404_050_ GFP-N_A11.ab1 | GASPGTSSTGSPGSSP SASTGTGPGSSTPSGA TGSP | 911 | GGTGCATCTCCTGGTACCAGCTCTACTGGTTCTCCAG GTTCTAGCCCTTCTGCTTCTACCGGTACCGGCCCAGG TAGCTCTACTCCTTCTGGTGCTACCGGTTCTCCA | 955 |
| LCW0404_051_ GFP-N_B11.ab1 | GSSTPSGATGSPGSST PSGATGSPGSSTPSGA TGSP | 912 | GGTAGCTCTACCCCGTCTGGTGCTACTGGCTCTCCAG GTAGCTCTACTCCTTCTGGTGCTACTGGTTCCCCAGG TAGCTCTACCCCGTCTGGTGCAACTGGCTCTCCA | 956 |
| LCW0404_052_ GFP-N_C11.ab1 | GASPGTSSTGSPGTPG SGTASSSPGASPGTSS TGSP | 913 | GGTGCATCCCCGGGTACCAGCTCTACCGGTTCTCCA GGTACTCCTGGCAGCGGTACTGCATCTTCCTCTCCAG GTGCTTCTCCGGGCACCAGCTCTACTGGTTCTCCA | 957 |

TABLE 25-continued

DNA and Amino Acid Sequences for 36-mer motifs

| File name | Amino acid sequence | SEQ ID NO: | Nucleotide sequence | SEQ ID NO: |
|---|---|---|---|---|
| LCW0404_053_GFP-N_D11.ab1 | GSSTPSGATGSPGSSP SASTGTGPGASPGTSS TGSP | 914 | GGTAGCTCTACTCCTTCTGGTGCAACTGGTTCTCCAG GTTCTAGCCCGTCTGCATCCACTGGTACCGGTCCAGG TGCTTCCCCTGGCACCAGCTCTACCGGTTCTCCA | 958 |
| LCW0404_057_GFP-N_E11.ab1 | GASPGTSSTGSPGSST PSGATGSPGSSPSAST GTGP | 915 | GGTGCATCTCCTGGTACTAGCTCTACTGGTTCTCCAG GTAGCTCTACTCCGTCTGGTGCAACCGGCTCTCCAGG TTCTAGCCCTTCTGCATCTACCGGTACTGGTCCA | 959 |
| LCW0404_060_GFP-N_F11.ab1 | GTPGSGTASSSPGSST PSGATGSPGASPGTSS TGSP | 916 | GGTACTCCTGGCAGCGGTACCGCATCTTCCTCTCCAG GTAGCTCTACTCCGTCTGGTGCAACTGGTTCCCCAGG TGCTTCTCCGGGTACCAGCTCTACCGGTTCTCCA | 960 |
| LCW0404_062_GFP-N_G11.ab1 | GSSTPSGATGSPGTPG SGTASSSPGSSTPSGA TGSP | 917 | GGTAGCTCTACCCCGTCTGGTGCAACCGGCTCCCCA GGTACTCCTGGTAGCGGTACCGCTTCTTCTTCTCCAG GTAGCTCTACTCCGTCTGGTGCTACCGGCTCCCCA | 961 |
| LCW0404_066_GFP-N_H11.ab1 | GSSPSASTGTGPGSSP SASTGTGPGASPGTSS TGSP | 918 | GGTTCTAGCCCTTCTGCATCCACCGGTACCGGCCCAG GTTCTAGCCCGTCTGCTTCTACCGGTACTGGTCCAGG TGCTTCTCCGGGTACTAGCTCTACTGGTTCTCCA | 962 |
| LCW0404_067_GFP-N_A12.ab1 | GTPGSGTASSSPGSST PSGATGSPGSNPSAST GTGP | 919 | GGTACCCGGGTAGCGGTACCGCTTCTTCTTCTCCAG GTAGCTCTACTCCGTCTGGTGCTACCGGCTCTCCAGG TTCTAACCCTTCTGCATCCACCGGTACCGGCCCA | 963 |
| LCW0404_068_GFP-N_B12.ab1 | GSSPSASTGTGPGSST PSGATGSPGASPGTSS TGSP | 920 | GGTTCTAGCCCTTCTGCATCTACTGGTACTGGCCCAG GTAGCTCTACTCCTTCTGGTGCTACCGGCTCTCCAGG TGCTTCTCCGGGTACTAGCTCTACCGGTTCTCCA | 964 |
| LCW0404_069_GFP-N_C12.ab1 | GSSTPSGATGSPGASP GTSSTGSPGTPGSGTA SSSP | 921 | GGTAGCTCTACCCCTTCTGGTGCAACCGGCTCTCCAG GTGCATCCCGGGTACCAGCTCTACCGGTTCTCCAG GTACTCCGGGTAGCGGTACCGCTTCTTCCTCTCCA | 965 |
| LCW0404_070_GFP-N_D12.ab1 | GSSTPSGATGSPGSST PSGATGSPGSSTPSGA TGSP | 922 | GGTAGCTCTACTCCGTCTGGTGCAACCGGTTCCCCAG GTAGCTCTACCCCTTCTGGTGCAACCGGCTCCCCAGG TAGCTCTACCCCTTCTGGTGCAACTGGCTCTCCA | 966 |
| LCW0404_073_GFP-N_E12.ab1 | GASPGTSSTGSPGTPG SGTASSSPGSSTPSGA TGSP | 923 | GGTGCTTCTCCTGGCACTAGCTCTACCGGTTCTCCAG GTACCCCTGGTAGCGGTACCGCATCTTCCTCTCCAGG TAGCTCTACTCCTTCTGGTGCTACTGGTTCCCCA | 967 |
| LCW0404_075_GFP-N_F12.ab1 | GSSTPSGATGSPGSSP SASTGTGPGSSPSAST GTGP | 924 | GGTAGCTCTACCCCGTCTGGTGCTACTGGCTCCCAG GTTCTAGCCCTTCTGCATCCACCGGTACCGGTCCAGG TTCTAGCCCGTCTGCATCTACTGGTACTGGTCCA | 968 |
| LCW0404_080_GFP-N_G12.ab1 | GASPGTSSTGSPGSSP SASTGTGPGSSPSAST GTGP | 925 | GGTGCTTCCCCGGGCACCAGCTCTACTGGTTCTCCAG GTTCTAGCCCGTCTGCTTCTACTGGTACTGGTCCAGG TTCTAGCCCTTCTGCTTCCACTGGTACTGGTCCA | 969 |
| LCW0404_081_GFP-N_H12.ab1 | GASPGTSSTGSPGSSP SASTGTGPGTPGSGTA SSSP | 926 | GGTGCTTCCCCGGGTACCAGCTCTACCGGTTCTCCAG GTTCTAGCCCTTCTGCTTCTACCGGTACCGGTCCAGG TACCCCTGGCAGCGGTACCGCATCTTCCTCTCCA | 970 |

Example 5: Construction of XTEN_AE864

XTEN_AE864 was constructed from serial dimerization of XTEN_AE36 to AE72, 144, 288, 576 and 864. A collection of XTEN_AE72 segments was constructed from 37 different segments of XTEN_AE36. Cultures of E. coli harboring all 37 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AE72. This library of XTEN_AE72 segments was designated LCW0406. All clones from LCW0406 were combined and dimerized again using the same process as described above yielding library LCW0410 of XTEN_AE144. All clones from LCW0410 were combined and dimerized again using the same process as described above yielding library LCW0414 of XTEN_AE288. Two isolates LCW0414.001 and LCW0414.002 were randomly picked from the library and sequenced to verify the identities. All clones from LCW0414 were combined and dimerized again using the same process as described above yielding library LCW0418 of XTEN_AE576. We screened 96 isolates from library LCW0418 for high level of GFP fluorescence. 8 isolates with right sizes of inserts by PCR and strong fluorescence were sequenced and 2 isolates (LCW0418.018 and LCW0418.052) were chosen for future use based on sequencing and expression data.

The specific clone pCW0432 of XTEN_AE864 was constructed by combining LCW0418.018 of XTEN_AE576 and LCW0414.002 of XTEN_AE288 using the same dimerization process as described above.

Example 6: Construction of XTEN_AG864

Using the several consecutive rounds of dimerization, we assembled a collection of XTEN_AG864 sequences starting from segments of XTEN_AD36 listed in Example 1. These sequences were assembled as described in Example 3. Several isolates from XTEN_AG864 were evaluated and found to show good expression and excellent solubility under physiological conditions. A full length clone of XTEN_AG864 had excellent solubility and showed half-life exceeding 60 h in cynomolgus monkeys.

Example 7: Construction of CBD-XTEN-Cys, a Cysteine-Engineered XTEN

A cysteine island (CysIsland) encoding the amino acid sequence GGSPAGSCTSP (SEQ ID NO: 187) containing one cysteine was introduced by annealed oligos in the CBD-stuffer-GFP vector to obtain CBD-CysIsland-GFP, where CysIsland is flanked by the restriction sites BsaI and BbsI. The CBD-stuffer-GFP vector is a pET30 derivative from Novagen with TEV protease recognition site between CBD and the stuffer. Constructs were previously generated by replacing the stuffer in CBD-stuffer-GFP vector with genes encoding XTEN_AE288 and XTEN_AE576. The plasmid of CBD-XTEN_AE288-GFP was digested with BsaI/NcoI to generate the small fragment as the insert. The plasmid of CBD-CysIsland-GFP was digested with BbsI/NcoI to generate the large fragment as the vector. The insert and vector fragments were ligated and the ligation mixture was electroporated into BL21-Gold (DE3) cells to obtain transformants of CBD-CysIsland-XTEN_AE288-GFP. Similarly, the plasmid of CBD-CysIsland-XTEN_AE288-GFP was digested with BsaI/NcoI to generate the small fragment as the insert. The plasmid of CBD-XTEN_AE576-GFP was digested with BbsI/NcoI to generate the large fragment as the vector. The insert and vector fragments were ligated and the ligation mixture was electroporated into BL21-Gold (DE3) cells to obtain transformants of CBD-XTEN_AE576-CysIsland-XTEN_AE288-GFP. Finally, the plasmid of CBD-XTEN_AE576-CysIsland-XTEN_AE288-GFP was digested with BbsI/HindIII to remove GFP and ligate with annealed oligos for the stop codon, and the ligation mixture was electroporated into BL21-Gold (DE3) cells to obtain transformants of CBD-XTEN_AE576-CysIsland-XTEN_AE288, which has the DNA and encoded amino acid sequences that follow in Table 26. Additional constructs can be created with cysteines inserted at different locations within the XTEN sequence by the selection of restriction sites appropriate for the given location, including multiple insertions. The method could also be utilized to create lysine-engineered XTEN by substitution of codons encoding lysine for those encoding cysteine in the oligonucleotides.

TABLE 26

DNA and amino acid sequence of Cys-engineered XTEN

| Clone Name | DNA Sequence | Amino Acid Sequence |
|---|---|---|
| CBD-TEV-AE576-CysIsland-AE288 | ATGGCAAATACACCGGTATCAGGCAATTTGAAGGTTGA | MANTPVSGNLK |
| | ATTCTACAACAGCAATCCTTCAGATACTACTAACTCAAT | VEFYNSNPSDTT |
| | CAATCCTCAGTTCAAGGTTACTAATACCGGAAGCAGTGC | NSINPQFKVTNT |
| | AATTGATTTGTCCAAACTCACATTGAGATATTATTATAC | GSSAIDLSKLTL |
| | AGTAGACGGACAGAAAGATCAGACCTTCTGGGCTGACC | RYYYTVDGQKD |
| | ATGCTGCAATAATCGGCAGTAACGGCAGCTACAACGGA | QTFWADHAAIIG |
| | ATTACTTCAAATGTAAAAGGAACATTTGTAAAAATGAGT | SNGSYNGITSNV |
| | TCCTCAACAAATAACGCAGACACCTACCTTGAAATCAGC | KGTFVKMSSST |
| | TTTACAGGCGGAACTCTTGAACCGGGTGCACATGTTCAG | NNADTYLEISFT |
| | ATACAAGGTAGATTTGCAAAGAATGACTGGAGTAACTA | GGTLEPGAHVQI |
| | TACACAGTCAAATGACTACTCATTCAAGTCTGCTTCACA | QGRFAKNDWSN |
| | GTTTGTTGAATGGGATCAGGTAACAGCATACTTGAACGG | YTQSNDYSFKSA |
| | TGTTCTTGTATGGGGTAAAGAACCCGGTGGCAGTGTAGT | SQFVEWDQVTA |
| | AGGTTCAGGTTCAGGATCCGAAAATCTGTATTTTCAGGG | YLNGVLVWGKE |
| | TGGGTCTCCAGGTAGCCCGGCTGGCTCTCCTACCTCTAC | PGGSVVGSGSGS |
| | TGAGGAAGGTACTTCTGAAAGCGCTACTCCTGAGTCTGG | ENLYFQGGSPGS |
| | TCCAGGTACCTCTACTGAACCGTCCGAAGGTAGCGCTCC | PAGSPTSTEEGT |
| | AGGTAGCCCAGCAGGCTCTCCGACTTCCACTGAGGAAG | SESATPESGPGT |
| | GTACTTCTACTGAACCTTCCGAAGGCAGCGCACCAGGTA | STEPSEGSAPGSP |
| | CCTCTACTGAACCTTCTGAGGGCAGCGCTCCAGGTACTT | AGSPTSTEEGTS |
| | CTGAAAGCGCTACCCCGGAATCTGGCCCAGGTAGCGAA | TEPSEGSAPGTS |
| | CCGGCTACTTCTGGTTCTGAAACCCCAGGTAGCGAACCG | TEPSEGSAPGTS |
| | GCTACCTCCGGTTCTGAAACTCCAGGTAGCCCGGCAGGC | ESATPESGPGSE |
| | TCTCCGACCTCTACTGAGGAAGGTACTTCTGAAAGCGCA | PATSGSETPGSE |
| | ACCCCGGAGTCCGGCCCAGGTACCTCTACCGAACCGTCT | PATSGSETPGSP |
| | GAGGGCAGCGCACCAGGTACTTCTACCGAACCGTCCGA | AGSPTSTEEGTS |
| | GGGTAGCGCACCAGGTAGCCCAGCAGGTTCTCCTACCTC | ESATPESGPGTS |
| | CACCGAGGAAGGTACTTCTACCGAACCGTCCGAGGGTA | TEPSEGSAPGTS |
| | GCGCACCAGGTACCTCTACTGAACCTTCTGAGGGCAGCG | TEPSEGSAPGSP |
| | CTCCAGGTACTTCTGAAAGCGCTACCCCGGAGTCCGGTC | AGSPTSTEEGTS |
| | CAGGTACTTCTACTGAACCGTCCGAAGGTAGCGCACCAG | TEPSEGSAPGTS |
| | GTACTTCTGAAAGCGCAACCCCTGAATCCGGTCCAGGTA | TEPSEGSAPGTS |
| | GCGAACCGGCTACTTCTGGCTCTGAGACTCCAGGTACTT | ESATPESGPGTS |
| | CTACCGAACCGTCCGAAGGTAGCGCACCAGGTACTTCTA | TEPSEGSAPGTS |
| | CTGAACCGTCTGAAGGTAGCGCACCAGGTACTTCTGAAA | ESATPESGPGSE |
| | GCGCAACCCCGGAATCCGGCCCAGGTACCTCTGAAAGC | PATSGSETPGTS |
| | GCAACCCCGGAGTCCGGCCCAGGTAGCCCTGCTGGCTCT | TEPSEGSAPGTS |
| | CCAACCTCCACCGAAGAAGGTACCTCTGAAAGCGCAAC | TEPSEGSAPGTS |
| | CCCTGAATCCGGCCCAGGTAGCGAACCGGCAACCTCCG | ESATPESGPGTS |

TABLE 26-continued

DNA and amino acid sequence of Cys-engineered XTEN

| Clone Name | DNA Sequence | Amino Acid Sequence |
|---|---|---|
| | GTTCTGAAACCCCAGGTACCTCTGAAAGCGCTACTCCGG<br>AGTCTGGCCCAGGTACCTCTACTGAACCGTCTGAGGGTA<br>GCGCTCCAGGTACTTCTACTGAACCGTCCGAAGGTAGCG<br>CACCAGGTACTTCTACCGAACCGTCCGAAGGCAGCGCTC<br>CAGGTACCTCTACTGAACCTTCCGAGGGCAGCGCTCCAG<br>GTACCTCTACCGAACCTTCTGAAGGTAGCGCACCAGGTA<br>CTTCTACCGAACCGTCCGAGGGTAGCGCACCAGGTAGCC<br>CAGCAGGTTCTCCTACCTCCACCGAGGAAGGTACTTCTA<br>CCGAACCGTCCGAGGGTAGCGCACCAGGTACCTCTGAA<br>AGCGCAACTCCTGAGTCTGGCCCAGGTAGCGAACCTGCT<br>ACCTCCGGCTCTGAGACTCCAGGTACCTCTGAAAGCGCA<br>ACCCCGGAATCTGGTCCAGGTAGCGAACCTGCAACCTCT<br>GGCTCTGAAACCCCAGGTACCTCTGAAAGCGCTACTCCT<br>GAATCTGGCCCAGGTACTTCTACTGAACCGTCCGAGGGC<br>AGCGCACCAGGTACTTCTGAAAGCGCTACTCCTGAGTCC<br>GGCCCAGGTAGCCCGGCTGGCTCTCCGACTTCCACCGAG<br>GAAGGTAGCCCGGCTGGCTCTCCAACTTCTACTGAAGAA<br>GGTAGCCCGGCAGGCTCTCCGACCTCTACTGAGGAAGGT<br>ACTTCTGAAAGCGCAACCCCGGAGTCCGGCCCAGGTACC<br>TCTACCGAACCGTCTGAGGGCAGCGCACCAGGTGGTAG<br>CCCGGCTGGCTCTTGTACCTCTCCAGGTACCTCTGAAAG<br>CGCAACTCCTGAGTCTGGCCCAGGTAGCGAACCTGCTAC<br>CTCCGGCTCTGAGACTCCAGGTACCTCTGAAAGCGCAAC<br>CCCGGAATCTGGTCCAGGTAGCGAACCTGCAACCTCTGG<br>CTCTGAAACCCCAGGTACCTCTGAAAGCGCTACTCCTGA<br>ATCTGGCCCAGGTACTTCTACTGAACCGTCCGAGGGCAG<br>CGCACCAGGTAGCCCTGCTGGCTCTCCAACCTCCACCGA<br>AGAAGGTACCTCTGAAAGCGCAACCCCTGAATCCGGCC<br>CAGGTAGCGAACCGGCAACCTCCGGTTCTGAAACCCCA<br>GGTACTTCTGAAAGCGCTACTCCTGAGTCCGGCCCAGGT<br>AGCCCGGCTGGCTCTCCGACTTCCACCGAGGAAGGTAGC<br>CCGGCTGCTCTCCAACTTCTACTGAAGAAGGTACTTCT<br>ACCGAACCTTCCGAGGGCAGCGCACCAGGTACTTCTGAA<br>AGCGCTACCCCTGAGTCCGGCCCAGGTACTTCTGAAAGC<br>GCTACTCCTGAATCCGGTCCAGGTACTTCTGAAAGCGCT<br>ACCCCGGAATCTGGCCCAGGTAGCGAACCGGCTACTTCT<br>GGTTCTGAAACCCCAGGTAGCGAACCGGCTACCTCCGGT<br>TCTGAAACTCCAGGTAGCCCAGCAGGCTCTCCGACTTCC<br>ACTGAGGAAGGTACTTCTACTGAACCTTCCGAAGGCAGC<br>GCACCAGGTACCTCTACTGAACCTTCTGAGGGCAGCGCT<br>CCAGGTAGCGAACCTGCAACCTCTGGCTCTGAAACCCCA<br>GGTACCTCTGAAAGCGCTACTCCTGAATCTGGCCCAGGT<br>ACTTCTACTGAACCGTCCGAGGGCAGCGCACCAGGTTAA<br>(SEQ ID NO: 971) | ESATPESGPGSP<br>AGSPTSTEEGTS<br>ESATPESGPGSE<br>PATSGSETPGTS<br>ESATPESGPGTS<br>TEPSEGSAPGTS<br>TEPSEGSAPGTS<br>TEPSEGSAPGTS<br>TEPSEGSAPGTS<br>TEPSEGSAPGTS<br>TEPSEGSAPGSP<br>AGSPTSTEEGTS<br>TEPSEGSAPGTS<br>ESATPESGPGSE<br>PATSGSETPGTS<br>ESATPESGPGSE<br>PATSGSETPGTS<br>ESATPESGPGTS<br>TEPSEGSAPGTS<br>ESATPESGPGSP<br>AGSPTSTEEGSP<br>AGSPTSTEEGSP<br>AGSPTSTEEGTS<br>ESATPESGPGTS<br>TEPSEGSAPGGS<br>PAGSCTSPGTSE<br>SATPESGPGSEP<br>ATSGSETPGTSE<br>SATPESGPGSEP<br>ATSGSETPGTSE<br>SATPESGPGTST<br>EPSEGSAPGSPA<br>GSPTSTEEGTSES<br>ATPESGPGSEPA<br>TSGSETPGTSES<br>ATPESGPGSPAG<br>SPTSTEEGSPAG<br>SPTSTEEGTSTEP<br>SEGSAPGTSESA<br>TPESGPGTSESA<br>TPESGPGTSESA<br>TPESGPGSEPAT<br>SGSETPGSEPAT<br>SGSETPGSPAGS<br>PTSTEEGTSTEPS<br>EGSAPGTSTEPS<br>EGSAPGSEPATS<br>GSETPGTSESAT<br>PESGPGTSTEPSE<br>GSAPG (SEQ ID NO: 972) |

Example 8: Construction of Cys3-XTEN

A pair of primers was designed to introduce the restriction site BamHI and cysteine island 1 of sequence GRATAE-AAGCGTAEAA (SEQ ID NO: 973) at the N-terminus of XTEN_AE432-1, and a partial cysteine island 2 of sequence TAEAAG (SEQ ID NO: 974) and restriction site BbsI at C-terminus of XTEN_AE432-1. A second pair of primers was designed to introduce the restriction site BsaI and a partial cysteine island 2 of sequence GCGTAEAA (SEQ ID NO: 975) at the N-terminus of XTEN_AE432-2, and cysteine island 4 of sequence TAEAAGCGTAEAAR (SEQ ID NO: 976) with an 8×His-tag (H8) (SEQ ID NO: 20) and restriction site HindIII at the C-terminus of XTEN_AE432-2. The XTEN_AE432-1 contains the 1-432 amino acid sequence and XTEN_AE432-2 contains the 433-864 amino acid sequence encoded by the XTEN_AE864 gene. These two pairs of primers were used to amplify the XTEN_AE432-1 and XTEN_AE432-2 gene, respectively, by polymerase chain reaction (PCR). The PCR products of correct sizes were gel-purified and digested with the restriction enzymes BamHI/BbsI and BsaI/HindIII, respectively, as the inserts for ligation. A destination vector, a derivative of pET30 (Novagen) includes a CBD (cellulose binding domain)-stuffer with the flanking restriction sites BamHI and HindIII. The destination vector was digested with the restriction enzymes BamHI/HindIII to remove the stuffer and prepared as the vector. The vector was ligated with the BamHI/BbsI digested PCR product of XTEN_AE432-1 and BsaI/HindIII digested PCR of XTEN_AE432-2 above. The ligation mixture was transformed into E. coli TOP10 competent cells. Transformants were screened by DNA miniprep and the desired constructs were confirmed by DNA sequencing. Thus, the final plasmid yields the CBD-cysteine island 1-XTEN_AE432-cysteine island 2-XTEN_AE432-cysteine island 3-H8 ("H8" disclosed as SEQ ID NO: 20) gene under the control of a T7 promoter. The DNA sequences and protein sequences are provided in Table 27.

TABLE 27

Cys3-XTEN DNA and amino acid sequences

| Clone Name | DNA Sequence | Amino Acid Sequence |
|---|---|---|
| CBD-Cys1-AE432-Cys2-AE432-Cys3-H8 (AC673) ("H8" disclosed as SEQ ID NO: 20) | ATGGCTAATACCCCAGTGAGCGGCAACCTGAAAGTG GAATTCTACAATAGCAACCCGAGCGACACCACCAAC AGCATTAATCCGCAGTTCAAAGTGACCAACACGGGT AGCTCCGCGATCGATCTGTCGAAGCTGACGCTGCGT TACTATTACACGGTTGACGGTCAGAAAGATCAGACG TTCTGGGCTGACCATGCGGCCATTATTGGCAGCAAC GGTTCCTACAACGGTATCACGAGCAATGTCAAAGGC ACTTTTGTTAAGATGAGCTCTTCGACCAACAATGCC GATACCTATCTGGAGATTAGCTTCACCGGTGGTACT CTGGAGCCGGGTGCACACGTTCAAATCCAAGGTCGC TTCGCAAAGAATGACTGGAGCAACTATACCCAGTCC AATGACTACAGCTTCAAAAGCGCTAGCCAATTTGTT GAATGGGATCAGGTCACCGCATACCTGAACGGCGTG CTGGTCTGGGGCAAGGAACCGGGTGGTAGCGTTGTC GGTTCTGGCAGCGGATCCggtcgtGCGACGGCAGAA GCCGCTGGCTgcGGTACTGCTGAAGCGGCAGGTAGC CCAGCTGGTAGCCCAACCTCTACCGAAGAAGGTACC TCTGAATCCGCTACTCCAGAATCCGGTCCTGGTACT AGCACTGAGCCAAGCGAAGGTTCTGCTCCAGGCTCC CCGGCAGGTAGCCCTACCTCTACCGAAGAGGGCACT AGCACCGAACCATCTGAGGGTTCCGCTCCTGGCACC TCCACTGAACCGTCCGAAGGCAGTGCTCCGGGTACT TCCGAAAGCGCAACTCCGGAATCCGGCCCTGGTTCT GAGCCTGCTACTTCCGGCTCTGAAACTCCAGGTAGC GAGCCAGCGACTTCTGGTTCTGAAACTCCAGGTTCA CCGGCGGGTAGCCCGACGAGCACGGAGGAAGGTACC TCTGAGTCGGCCACTCCTGAGTCCGGTCCGGGCACG AGCACCGAGCCGAGCGAGGGTTCAGCCCCGGGTACC AGCACGGAGCCGTCCGAGGGTAGCGCACCGGGTTCT CCGGCGGGCTCCCCTACGTCTACGGAAGAGGGTACG TCCACTGAACCTAGCGAGGGCAGCGCGCCAGGCACC AGCACTGAACCGAGCGAAGGCAGCGCACCTGGCACT AGCGAGTCTGCGACTCCGGAGAGCGGTCCGGGTACG AGCACGGAACCAAGCGAAGGCAGCGCCCCAGGTACC TCTGAATCTGCTACCCCAGAATCTGGCCCGGGTTCC GAGCCAGCTACCTCTGGTTCTGAAACCCCAGGTACT TCCACTGAACCAAGCGAAGGTAGCGCTCCTGGCACT TCTACTGAACCATCCGAAGGTTCCGCTCCTGGTACG TCTGAAAGCGCTACCCCTGAAAGCGGCCCAGGCACC TCTGAAAGCGCTACTCCTGAGAGCGGTCCAGGCTCT CCAGCAGGTTCTCCAACCTCCACTGAAGAAGGCACC TCTGAGTCTGCTACCCCTGAATCTGGTCCTGGCTCC GAACCTGCTACCTCTGGTTCCGAAACTCCAGGTACC TCGGAATCTGCGACTCCGGAATCTGGCCCGGGCACG AGCACGGAGCCGTCTGAGGGTAGCGCACCAGGTACC AGCACTGAGCCTTCTGAGGGCTCTGCACCGGGTACC TCCACGGAACCTTCGGAAGGTTCTGCGCCGGGTACC TCCACTGAGCCATCCGAGGGTTCAGCACCAGGTACT AGCACGGAACCGTCCGAGGGCTCTGCACCAGGTACG AGCACCGAACCGTCGGAGGGTAGCGCTCCAGGTAGC CCAGCGGGCTCTCCGACAAGCACCGAAGAGGCACC AGCACCGAGCCGTCCGAAGGTTCCGCACCAACCGCT GAAGCCGCAGGTtgtGGCACTGCGGAAGCTGCAGGT ACAAGCGAGAGCGCGACTCCTGAATCTGGTCCGGGT AGCGAGCCTGCAACCAGCGGTTCTGAGACGCCGGGC AATCTGCGACCCCGGAGTCCGGTCCAGGTTCAGAGC ACTTCCGCGGCGACGAGCGGTTCGGAAACGCCGGGT ACGTCTGAATCAGCCACGCCGGAGTCTGGTCCGGGT GGCTCGACCAAGCGAAGGTTCGGCACCGGGT ACTAGCGAGAGCGCAACCCCTGAAAGCGGTCCGGGC AGCCCGGCAGGTTCTCCAACCAGCACCGAAGAAGGT TCCCCTGCTGGTAGCCCGACCTCTACGGAGGAAGGT AGCCCTGCAGGTTCCCCAACTTCTACTGAGGAAGGT ACTTCTGAGTCCGCTACCCCAGAAAGCGGTCCTGGT ACCTCCACTGAACCGTCTGAAGGCTCTGCACCAGGC ACTTCTGAGTCTGCTACTCCAGAAAGCGGCCCAGGT TCTGAACCACAACTTCTGGCTCTGAGACTCCAGGC ACTTCTGAGTCCGCAACGCCTGAATCCGGTCCTGGT TCTGAACCAGCTACTTCCGGCAGCGAAACCCCAGGT ACCTCTGAGTCTGCGACTCCAGAGTCTGGTCCTGGT ACTTCCACTGAGCCTAGCGAGGGTTCCGCACCAGGT TCTCCGGCTGGTAGCCCGACCAGCACGGAGGAGGGT | MANTPVSGNLKVEFY NSNPSDTTNSINPQF KVTNTGSSAIDLSKL TLRYYYTVDGQKDQT FWADHAAIIGSNGSY NGITSNVKGTFVKMS SSTNNADTYLEISFT GGTLEPGAHVQIQGR FAKNDWSNYTQSNDY SFKSASQFVEWDQVT AYLNGVLVWGKEPGG SVVGSGSGSGRATAE AAGCGTAEAAGSPAG SPTSTEEGTSESATP ESGPGTSTEPSEGSA PGSPAGSPTSTEEGT STEPSEGSAPGTSTE PSEGSAPGTSESATP ESGPGSEPATSGSET PGSEPATSGSETPGS PAGSPTSTEEGTSES ATPESGPGTSTEPSE GSAPGTSTEPSEGSA PGSPAGSPTSTEEGT STEPSEGSAPGTSTE PSEGSAPGTSESATP ESGPGTSTEPSEGSA PGTSESATPESGPGS EPATSGSETPGTSTE PSEGSAPGTSTEPSE GSAPGTSESATPESG PGTSESATPESGPGS PAGSPTSTEEGTSES ATPESGPGSEPATSG SETPGTSESATPESG PGTSTEPSEGSAPGT STEPSEGSAPGTSTE PSEGSAPGTSTEPSE GSAPGTSTEPSEGSA PGTSTEPSEGSAPGS PAGSPTSTEEGTSTE PSEGSAPTAEAAGCG TAEAAGTSESATPES GPGSEPATSGSETPG TSESATPESGPGSEP ATSGSETPGTSESAT PESGPGTSTEPSEGS APGTSESATPESGPG SPAGSPTSTEEGSPA GSPTSTEEGSPAGSP TSTEEGTSESATPES GPGTSTEPSEGSAPG TSESATPESGPGSEP ATSGSETPGTSESAT PESGPGSEPATSGSE TPGTSESATPESGPG TSTEPSEGSAPGSPA GSPTSTEEGTSESAT PESGPGSEPATSGSE TPGTSESATPESGPG SPAGSPTSTEEGSPA GSPTSTEEGTSTEPS EGSAPGTSESATPES GPGTSTEPSEGSAPG TSESATPESGPGSEP ATSGSETPGSEPATS GSETPGSPAGSPTST EEGTSTEPSEGSAPG TSTEPSEGSAPGSEP ATSGSETPGTSESAT PESGPGTSTEPSEGS APTAEAAGCGTAEAA |

TABLE 27-continued

Cys3-XTEN DNA and amino acid sequences

| Clone Name | DNA Sequence | Amino Acid Sequence |
|---|---|---|
| | ACGTCTGAATCTGCAACGCCGGAATCGGGCCCAGGT<br>TCGGAGCCTGCAACGTCTGGCAGCGAAACCCCGGGT<br>ACCTCCGAATCTGCTACACCGGAAAGCGGTCCTGGC<br>AGCCCTGCTGGTTCTCCAACCTCTACCGAGGAGGGT<br>TCACCGGCAGGTAGCCCGACTAGCACTGAAGAAGGT<br>ACTAGCACGGAGCCGAGCGAGGGTAGTGCTCCGGGT<br>ACGAGCGAGAGCGCAACGCCAGAGAGCGGTCCAGGC<br>ACCAGCGAATCGGCCACCCCTGAGAGCGGCCCAGGT<br>ACTTCTGAGAGCGCCACTCCTGAATCCGGCCCTGGT<br>AGCGAGCCGGCAACCTCCGGCTCAGAAACTCCTGGT<br>TCGGAACCAGCGACCAGCGGTTCTGAAACTCCGGGT<br>AGCCCGGCAGGCAGCCCAACGAGCACCGAAGAGGGT<br>ACCAGCACGGAACCGAGCGAGGGTTCTGCCCCGGGT<br>ACTTCCACCGAACCATCGGAGGGCTCTGCACCTGGT<br>AGCGAACCTGCGACGTCTGGTTCTGAAACGCCGGGT<br>ACCAGCGAAAGCGCTACCCCAGAATCCGGTCCGGGC<br>ACTAGCACCGAGCCATCGGAGGGCTCCGCACCAACT<br>GCAGAAGCGGCTGGTtgtGGCACCGCCGAAGCAGCT<br>cgtCATCACCATCACCACCATCATCACTAA<br>(SEQ ID NO: 977) | RHHHHHHHH<br>(SEQ ID NO: 978) |

Example 9: Construction of Lys2-XTEN

A pair of primers was designed to introduce the restriction site BamHI and the amino acid sequence GRGSP (SEQ ID NO: 979) at the N-terminus of XTEN_AE432-1, and the amino acid sequence TAEAAG (SEQ ID NO: 974) and restriction site BbsI at the C-terminus of XTEN_AE432-1. A second pair of primers was designed to introduce the restriction site BsaI and an amino acid sequence with an incorporated lysine of GKPGTAEAA (SEQ ID NO: 980) at the N-terminus of XTEN_AE432-2, and an amino acid sequence with an incorporated lysine of GKAT (SEQ ID NO: 981) with an 8×His-tag (H8) (SEQ ID NO: 20) and restriction site HindIII at C-terminus of XTEN_AE432-2. XTEN_AE432-1 contains the 1-432 amino acid sequence and XTEN_AE432-2 contains the 433-864 amino acid sequence encoded by the XTEN_AE864 gene. These two pairs of primers were used to amplify the XTEN_AE432-1 and XTEN_AE432-2 gene, respectively, by polymerase chain reaction (PCR). The PCR products of right sizes were gel-purified and digested with the restriction enzymes BamHI/BbsI and BsaI/HindIII, respectively, as the inserts for ligation. A destination vector, derivative of pET30 (Novagen), of CBD (cellulose binding domain)-stuffer with the flanking restriction sites BamHI and HindIII was digested with the restriction enzymes BamHI/HindIII to remove the stuffer and prepared as the vector. Ligate the vector with the BamHI/BbsI digested PCR product of XTEN_AE432-1 and BsaI/HindIII digested PCR of XTEN_AE432-2 above. The ligation mixture was transformed into E. coli TOP10 competent cells. Transformants were screened by DNA miniprep and the desired constructs were confirmed by DNA sequencing. Thus, the final plasmid yields the CBD-GRGSP (SEQ ID NO: 979)-XTEN_AE432-TAEAAGKPGTAEAA (SEQ ID NO: 982)-XTEN_AE432-GKAT-H8 (SEQ ID NO: 20) gene under the control of a T7 promoter. The DNA sequences and protein sequences are provided in Table 28.

TABLE 28

Lys2-XTEN DNA and amino acid sequences

| Clone Name | DNA Sequence | Amino Acid Sequence |
|---|---|---|
| CBD-R-<br>AE432-K-<br>AE432-K-<br>H8 (AC698)<br>(" H8"<br>disclosed<br>as SEQ ID<br>NO: 20) | ATGGCTAATACCCCAGTGAGCGGCAACCTGAAAGT<br>GGAATTCTACAATAGCAACCCGAGCGACACCACC<br>AACAGCATTAATCCGCAGTTCAAAGTGACCAACAC<br>GGGTAGCTCCGCGATCGATCTGTCGAAGCTGACGC<br>TGCGTTACTATTACACGGTTGACGGTCAGAAAGAT<br>CAGACGTTCTGGGCTGACCATGCGGCCATTATTGG<br>CAGCAACGGTTCCTACAACGGTATCACGAGCAATG<br>TCAAAGGCACTTTTGTTAAGATGAGCTCTTCGACC<br>AACAATGCCGATACCTATCTGGAGATTAGCTTCAC<br>CGGTGGTACTCTGGAGCCGGGTGCACACGTTCAAA<br>TCCAAGGTCGCTTCGCAAAGAATGACTGGAGCAAC<br>TATACCCAGTCCAATGACTACAGCTTCAAAAGCGC<br>TAGCCAATTTGTTGAATGGGATCAGGTCACCGCAT<br>ACCTGAACGGCGTGCTGGTCTGGGGCAAGGAACC<br>GGGTGGTAGCGTTGTCGGTTCTGGCAGCGGATCCg<br>gtcgtGGGTCTCCAGGTAGCCCAGCTGGTAGCCCAAC<br>CTCTACCGAAGAAGGTACCTCTGAATCCGCTACTC<br>CAGAATCCGGTCCTGGTACTAGCACTGAGCCAAGC<br>GAAGGTTCTGCTCCAGGCTCCCCGGCAGGTAGCCC<br>TACCTCTACCGAAGAGGGCACTAGCACCGAACCAT | MANTPVSGNLKVEFY<br>NSNPSDTTNSINPQF<br>KVTNTGSSAIDLSKL<br>TLRYYYTVDGQKDQT<br>FWADHAAIIGSNGSY<br>NGITSNVKGTFVKMS<br>SSTNNADTYLEISFT<br>GGTLEPGAHVQIQGR<br>FAKNDWSNYTQSNDY<br>SFKSASQFVEWDQVT<br>AYLNGVLVWGKEPGG<br>SVVGSGSGRGSPG<br>SPAGSPTSTEEGTSE<br>SATPESGPGTSTEPS<br>EGSAPGSPAGSPTST<br>EEGTSTEPSEGSAPG<br>TSTEPSEGSAPGTSE<br>SATPESGPGSEPATS<br>GSETPGSEPATSGSE<br>TPGSPAGSPTSTEEG |

TABLE 28-continued

Lys2-XTEN DNA and amino acid sequences

| Clone Name | DNA Sequence | Amino Acid Sequence |
|---|---|---|
| | CTGAGGGTTCCGCTCCTGGCACCTCCACTGAACCG<br>TCCGAAGGCAGTGCTCCGGGTACTTCCGAAAGCGC<br>AACTCCGGAATCCGGCCCTGGTTCTGAGCCTGCTA<br>CTTCCGGCTCTGAAACTCCAGGTAGCGAGCCAGCG<br>ACTTCTGGTTCTGAAACTCCAGGTTCACCGGCGGG<br>TAGCCCGACGAGCACGGAGGAAGGTACCTCTGAG<br>TCGGCCACTCCTGAGTCCGGTCCGGGCACGAGCAC<br>CGAGCCGAGCGAGGGTTCAGCCCCGGGTACCAGC<br>ACGGAGCCGTCCGAGGGTAGCGCACCGGGTTCTCC<br>GGCGGGCTCCCCTACGTCTACGGAAGAGGGTACGT<br>CCACTGAACCTAGCGAGGGCAGCGCGCCAGGCAC<br>CAGCACTGAACCGAGCGAAGGCAGCGCACCTGGC<br>ACTAGCGAGTCTGCGACTCCGGAGAGCGGTCCGG<br>GTACGAGCACGGAACCAAGCGAAGGCAGCGCCCC<br>AGGTACCTCTGAATCTGCTACCCCAGAATCGGCC<br>CGGGTTCCGAGCCAGCTACCTCTGGTTCTGAAACC<br>CCAGGTACTTCCACTGAACCAAGCGAAGGTAGCGC<br>TCCTGGCACTTCTACTGAACCATCCGAAGGTTCCG<br>CTCCTGGTACGTCTGAAAGCGCTACCCCTGAAAGC<br>GGCCCAGGCACCTCTGAAAGCGCTACTCCTGAGAG<br>CGGTCCAGGCTCTCCAGCAGGTTCTCCAACCTCCA<br>CTGAAGAAGGCACCTCTGAGTCTGCTACCCCTGAA<br>TCTGGTCCTGGCTCCGAACCTGCTACCTCTGGTTCC<br>GAAACTCCAGGTACCTCGGAATCTGCGACTCCGGA<br>ATCTGGCCCGGGCACGAGCACGGAGCCGTCTGAG<br>GGTAGCGCACCAGGTACCAGCACTGAGCCTTCTGA<br>GGGCTCTGCACCGGGTACCTCCACGGAACCTTCGG<br>AAGGTTCTGCGCCGGGTACCTCCACTGAGCCATCC<br>GAGGGTTCAGCACCAGGTACTAGCACGGAACCGT<br>CCGAGGGCTCTGCACCAGGTACGAGCACCGAACC<br>GTCGGAGGGTAGCGCTCCAGGTAGCCCAGCGGGC<br>TCTCCGACAAGCACCGAAGAAGGCACCAGCACCG<br>AGCCGTCCGAAGGTTCCGCACCAACCGCTGAAGCC<br>GCAGGTaaaccgGGCACTGCGGAAGCTGCAGGTACA<br>AGCGAGAGCGCGACTCCTGAATCTGGTCCGGGTAG<br>CGAGCCTGCAACCAGCGGTTCTGAGACGCCGGGC<br>ACTTCCGAATCTGCGACCCCGGAGTCCGGTCCAGG<br>TTCAGAGCCGGCGACGAGCGGTTCGGAAACGCCG<br>GGTACGTCTGAATCAGCCACGCCGGAGTCTGGTCC<br>GGGTACCTCGACCGAACCAAGCGAAGGTTCGGCA<br>CCGGGTACTAGCGAGAGCGCAACCCCTGAAAGCG<br>GTCCGGGCAGCCCGGCAGGTTCTCCAACCAGCACC<br>GAAGAAGGTTCCCCTGCTGGTAGCCCGACCTCTAC<br>GGAGGAAGGTAGCCCTGCAGGTTCCCCAACTTCTA<br>CTGAGGAAGGTACTTCTGAGTCCGCTACCCCAGAA<br>AGCGGTCCTGGTACCTCCACTGAACCGTCTGAAGG<br>CTCTGCACCAGGCACTTCTGAGTCTGCTACTCCAG<br>AAAGCGGCCCAGGTTCTGAACCAGCAACTTCTGGC<br>TCTGAGACTCCAGGCACTTCTGAGTCCGCAACGCC<br>TGAATCCGGTCCTGGTTCTGAACCAGCTACTTCCG<br>GCAGCGAAACCCCAGGTACCTCTGAGTCTGCGACT<br>CCAGAGTCTGGTCCTGGTACTTCCACTGAGCCTAG<br>CGAGGGTTCCGCACCAGGTTCTCCGGCTGGTAGCC<br>CGACCAGCACGGAGGAGGGTACGTCTGAATCTGC<br>AACGCCGGAATCGGGCCCAGGTTCGGAGCCTGCA<br>ACGTCTGGCAGCGAAACCCCGGGTACCTCCGAATC<br>TGCTACACCGGAAAGCGGTCCTGGCAGCCCTGCTG<br>GTTCTCCAACCTCTACCGAGGAGGGTTCACCGGCA<br>GGTAGCCCGACTAGCACTGAAGAAGGTACTAGCA<br>CGGAGCCGAGCGAGGGTAGTGCTCCGGGTACGAG<br>CGAGAGCGCAACGCCAGAGAGCGGTCCAGGCACC<br>AGCGAATCGGCCACCCCTGAGAGCGGCCCAGGTA<br>CTTCTGAGAGCGCCACTCCTGAATCCGGCCCTGGT<br>AGCGAGCCGGCAACCTCCGGCTCAGAAACTCCTGG<br>TTCGGAACCAGCGACCAGCGGTTCTGAAACTCCGG<br>GTAGCCCGGCAGGCAGCCCAACGAGCACCGAAGA<br>GGGTACCAGCACGGAACCGAGCGAGGGTTCTGCC<br>CCGGGTACTTCCACCGAACCATCGGAGGCTCTGC<br>ACCTGGTAGCGAACCTGCGACGTCTGGTTCTGAAA<br>CGCGGGTACCAGCGAAAGCGCTACCCCAGAATC<br>CGGTCCGGGCACTAGCACCGAGCCATCGGAGGGC<br>TCCGCACCAggtAAAgcgaccCATCACCATCACCACCA<br>TCATCACTAA<br>(SEQ ID NO: 983) | TSESATPESGPGTST<br>EPSEGSAPGTSTEPS<br>EGSAPGSPAGSPTST<br>EEGTSTEPSEGSAPG<br>TSTEPSEGSAPGTSE<br>SATPESGPGTSTEPS<br>EGSAPGTSESATPES<br>GPGSEPATSGSETPG<br>TSTEPSEGSAPGTST<br>EPSEGSAPGTSESAT<br>PESGPGTSESATPES<br>GPGSPAGSPTSTEEG<br>TSESATPESGPGSEP<br>ATSGSETPGTSESAT<br>PESGPGTSTEPSEGS<br>APGTSTEPSEGSAPG<br>TSTEPSEGSAPGTST<br>EPSEGSAPGTSTEPS<br>EGSAPGTSTEPSEGS<br>APGSPAGSPTSTEEG<br>TSTEPSEGSAPTAEA<br>AGKPGTAEAAGTSES<br>ATPESGPGSEPATSG<br>SETPGTSESATPESG<br>PGSEPATSGSETPGT<br>SESATPESGPGTSTE<br>PSEGSAPGTSESATP<br>ESGPGSPAGSPTSTE<br>EGSPAGSPTSTEEGS<br>PAGSPTSTEEGTSES<br>ATPESGPGTSTEPSE<br>GSAPGTSESATPESG<br>PGSEPATSGSETPGT<br>SESATPESGPGSEPA<br>TSGSETPGTSESATP<br>ESGPGTSTEPSEGSA<br>PGSPAGSPTSTEEGT<br>SESATPESGPGSEPA<br>TSGSETPGTSESATP<br>ESGPGSPAGSPTSTE<br>EGSPAGSPTSTEEGT<br>STEPSEGSAPGTSES<br>ATPESGPGTSESATP<br>ESGPGTSESATPESG<br>PGSEPATSGSETPGS<br>EPATSGSETPGSPAG<br>SPTSTEEGTSTEPSE<br>GSAPGTSTEPSEGSA<br>PGSEPATSGSETPGT<br>SESATPESGPGTSTE<br>PSEGSAPGKATHHHH<br>HHHH<br>(SEQ ID NO: 984) |

Example 10: Host Strain and Promoter for Expression of XTEN for Conjugation

Figure 43:
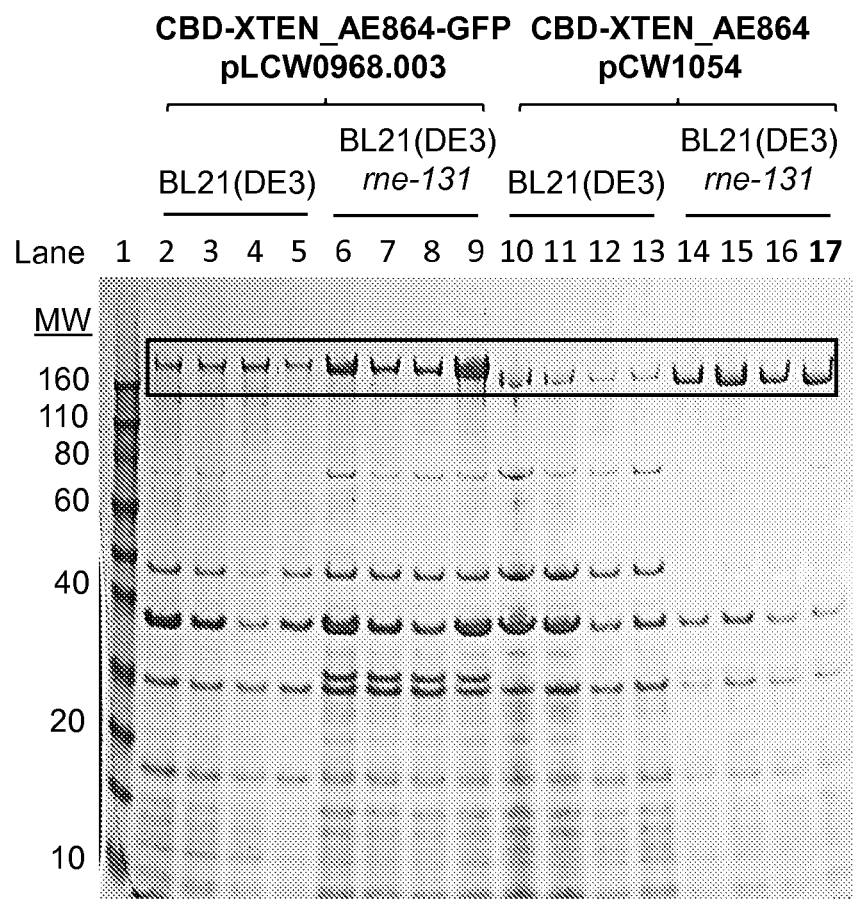
FIG. 43 shows an SDS-PAGE gel of the CBD-TEV site-XTEN_AE864 and CBD-TEV site-XTEN_AE864-GFP constructs expressed in E. coli BL21 DE3 me-131 and E. coli BL21 DE3 cells from shake flask cultures as described in Example 10. Gel lane samples with MW markers and expressed proteins from constructs are: 1) MW marker; 2-5) lysates from 4 independent flasks expressing CBD-TEV site-XTEN_AE864-GFP fusion protein in E. coli BL21 DE3; 6-9) lysates from 4 independent flasks expressing CBD-TEV site-XTEN_AE864-GFP fusion protein in E. coli BL21 DE3 me-131; 10-13) lysates from 4 independent flasks expressing CBD-TEV site-XTEN_AE864 fusion protein in E. coli BL21 DE3; 14-17) lysates from 4 independent flasks expressing CBD-TEV site-XTEN_AE864 fusion protein in E. coli BL21 DE3 me-131. Full-length protein spots appear within the outline box. Bands of lower molecular weight are host-cell proteins.
Figure 44:
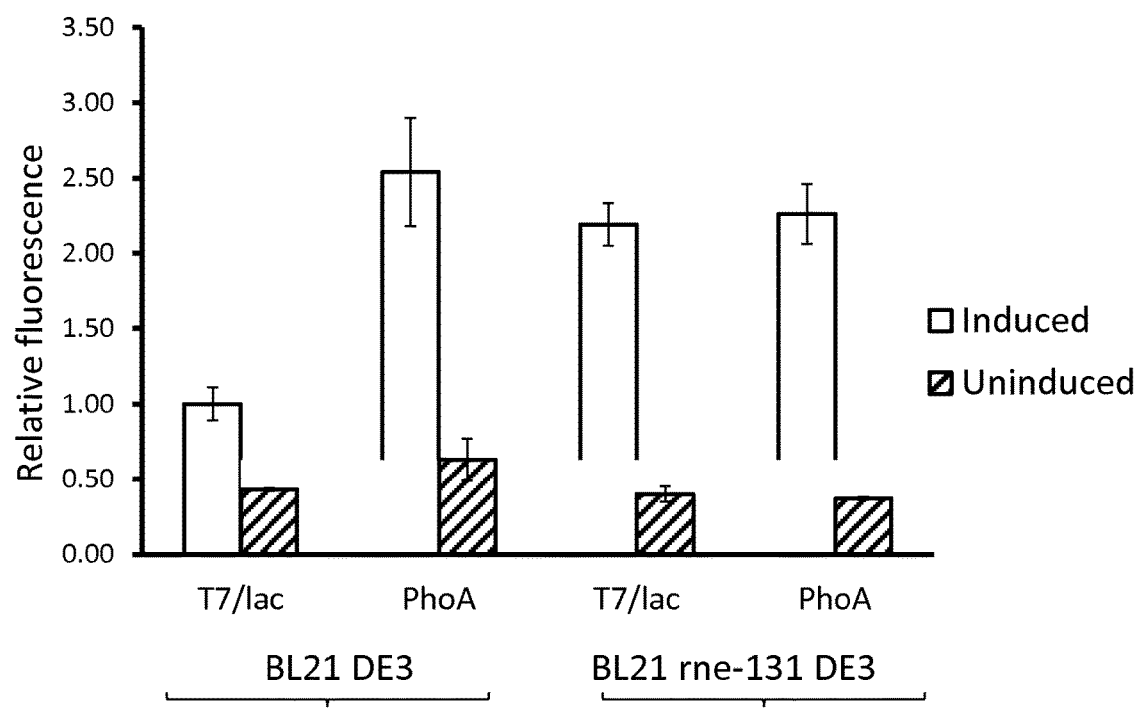
FIG. 44 shows relative GFP fluorescence of the CBD-TEV site-XTEN_AE864-GFP expressed in E. coli BL21 DE3 me-131 and E. coli BL21 DE3 cells from shake flask cultures as described in Example 10.

Plasmids pCW1054 expressing CBD-TEV site-XTEN_AE864 under the control of the T7/lac promoter, pLCW0968.003 expressing CBD-TEV site-XTEN_AE864-GFP under the control of the T7/lac promoter, and pLCW0970.030 expressing CBD-TEV site-XTEN_AE864-GFP under the control of the PhoA promoter, were transformed into both E. coli BL21 DE3 and E. coli BL21 DE3 me-131 (Lopez, P. J., et al. (1999) Mol. Microbiol. 33, 188-199). The me-131 mutation disrupts the 3' endoribonucleolytic activity of RNase E (Kido, M., et al. (1996) Journal of Bacteriology, 178: 3917-3925). Starter cultures of all six tranformants were prepared by picking single colonies to inoculate 2 mL of LB Broth media containing the appropriate selective antibiotic. The starter cultures were grown overnight and 0.5 mL was used to inoculate, in quadruplicate, 25 mL of 2xYT broth, for cells containing pCW1054 and pLCW0968.003, or 25 mL of PhoA induction broth (Amunix recipe 136-1) for cells containing pLCW0970.030. The cultures were shaken for 3 hours at 37° C. The temperature was then reduced to 26° C. for all of the cultures; and for cells containing pCW1054 and pLCW0968.003 protein expression was induced with IPTG at 1.0 mM final concentration. Induction of the PhoA promoter in pLCW070.030 is auto-induced upon depletion of phosphate from the culture media. The cultures were then shaken overnight at 26° C. Samples of each culture were lysed and 20 µl of each lysate were subjected to non-reducing SDS-PAGE using NuPAGE 4-12% Bis-Tris gel from Invitrogen, according to manufacturer's specifications, with Coomassie staining. The results (FIG. 43) showed that when either CBD-TEV site-XTEN_AE864-GFP or CBD-TEV site-XTEN_AE864 is expressed under the control of the T7/lac promoter the yield of the recombinant protein is significantly higher in the E. coli BL21 DE3 me-131 compared to the E. coli BL21 DE3 cells. Cells were also measured for GFP fluorescence using a fluorescent plate reader. The results (FIG. 44) showed that expression in E. coli BL21 DE3 cells of CBD-TEV site-XTEN_AE864-GFP under the control of the PhoA promoter is nearly three times greater than the expression of CBD-TEV site-XTEN_AE864-GFP under the control of the T7/lac promoter. In the E. coli BL21 DE3 me-131 both the T7/lac and PhoA promoters yielded similar levels of expression. Therefore, only upon inhibition of Rnase E 3' riboendocleolytic activity does T7/lac induction yield titers similar to that obtained using PhoA induction. Likely the faster rate of T7 RNAP transcription (Studier, W., et al. (1986) Journal of Molecular Biology 189: 113-130), relative to translation results in mRNA susceptible to endonucleolytic attack, while in the case of PhoA induction where transcription is mediated by the native E. coli RNA polymerase II, the rate of transcription is closely coupled to the rate of translation protecting the mRNA from endonucleolytic attack.

Example 11: Construction of 1xAmino-XTEN288

A pair of primers AE278BsaIfor-AACG and AE278-RH8HindIIrev ("H8" disclosed as SEQ ID NO: 20) were used to PCR the plasmid containing XTEN_AE864_003 in order to obtain the PCR product XTEN_AE278. Gel-purification of the band of the right size was performed, followed by digestion with BsaI/HindIII as the insert of XTEN_AE278-R-H8 ("H8" disclosed as SEQ ID NO: 20). A digestion of plasmid pCW1161, which encodes the gene of N-term-RP11-R-AE432_3Cys-R-H8 ("H8" disclosed as SEQ ID NO: 20) (construct AC763), with BsaI/HindIII was performed to remove the fragment of AE432_3Cys-R-H8 ("H8" disclosed as SEQ ID NO: 20) and gel-purify the large fragment as the vector. Ligation of the vector with the insert was performed and was used to transform BL21 competent cells to obtain the construct of N-term-RP11-R-AE288-R-H8 ("H8" disclosed as SEQ ID NO: 20). The XTEN length between the two trypsin digestion sites (R, Arginine) was calculated by XTEN_AE278 plus some flanking amino acids and equaled exactly 288 amino acids. Thus, the construct is designed to produce the precursor N-term-RP11-R-AE288-R-H8 ("H8" disclosed as SEQ ID NO: 20) (sequence in Table 29, below) and generate 1xAmino-XTEN288 (Seg 178 of Table 3, with an N-terminal amino group for conjugation) after removal of the N-term-RP11 tag and C-term 8xHis-tag (SEQ ID NO: 20) by trypsin digestion.

TABLE 29

DNA and amino acid sequence for 1xAmino-XTEN288

| Clone Name | DNA Sequence | Amino Acid Sequence |
|---|---|---|
| N-term-RP11-R-AE288-R-H8 ("H8" disclosed as SEQ ID NO: 20) | ATGAAAAACCCAGAGCAAGCAGAAGAACAAGCTGAAGAACAG | MKNPEQAEEQAEEQ |
| | CGCGAAGAAACACGTCCGCGTCCTCGCCCACGTCCACGTCCG | REETRPRPRPRPRPRP |
| | CGTCCACGCCCTCGTCCTCGTCCGCGCCCTCGTCCGagcgcg | RPRPRPRPRPSASRSA |
| | tctcgttccgctGGGTCTCCAAcgGGCCCAGGTTCTGAACCA | GSPTGPGSEPATSGSE |
| | GCAACTTCTGGCTCTGAGACTCCAGGCACTTCTGAGTCCGCA | TPGTSESATPESGPGS |
| | ACGCCTGAATCCGGTCCTGGTTCTGAACCAGCTACTTCCGGC | EPATSGSETPGTSESA |
| | AGCGAAACCCCAGGTACCTCTGAGTCTGCGACTCCAGAGTCT | TPESGPGTSTEPSEGS |
| | GGTCCTGGTACTTCCACTGAGCCTAGCGAGGGTTCCGCACCA | APGSPAGSPTSEEGT |
| | GGTTCTCCGGCTGGTAGCCCGACCAGCACGGAGGAGGGTACG | SESATPESGPGSEPAT |
| | TCTGAATCTGCAACGCCGGAATCGGGCCCAGGTTCGGAGCCT | SGSETPGTSESATPES |
| | GCAACGTCTGGCAGCGAAACCCCAGGTACCTCCGAATCTGCT | GPGSPAGSPTSTEEGS |
| | ACACCGGAAAGCGGTCCTGGCAGCCCTGCTGGTTCTCCAACC | PAGSPTSTEEGTSTEP |
| | TCTACCGAGGAGGGTTCACCGGCAGGTAGCCCGACTAGCACT | SEGSAPGTSESATPES |
| | GAAGAAGGTACTAGCACGGAGCCGAGCGAGGGTAGTGCTCCG | GPGTSESATPESGPGT |
| | GGTACGAGCGAGAGCGCAACGCCAGAGAGCGGTCCAGGCACC | SESATPESGPGSEPAT |
| | AGCGAATCGGCCACCCCTGAGAGCGGCCCAGGTACTTCTGAG | SGSETPGSEPATSGSE |
| | AGCGCCACTCCTGAATCCGGCCCTGGTAGCGAGCCGGCAACC | TPGSPAGSPTSTEEGT |
| | TCCGGCTCAGAAACTCCTGGTTCGGAACCAGCGACCAGCGGT | STEPSEGSAPGTSTEP |
| | TCTGAAACTCCGGGTAGCCCGGCAGGCAGCCCAACGAGCACC | SEGSAPGSEPATSGSE |
| | GAAGAGGGTACCAGCACGGAACCGAGCGAGGGTTCTGCCCCG | TPGTSESATPESGPGT |
| | GGTACTTCCACCGAACCATCGGAGGGCTCTGCACCTGGTAGC | STEPSEGSAPSASRSA |

TABLE 29-continued

DNA and amino acid sequence for 1xAmino-XTEN288

| Clone Name | DNA Sequence | Amino Acid Sequence |
|---|---|---|
| | GAACCTGCGACGTCTGGTTCTGAAACGCCGGGTACCAGCGAA AGCGCTACCCCAGAATCCGGTCCGGGCACTAGCACCGAGCCA TCGGAGGGCTCCGCACCAagcgcctctcgctccgcaCATCAC CATCACCACCATCATCACTAA (SEQ ID NO: 985) | HHHHHHHH (SEQ ID NO: 986) |

Example 12: Optimization for Expression of XTEN Constructs with RP11 Affinity Tag 1. 1. Design and Construction of Constructs Encoding N-Term-RP11-AE864-GFP and MalEss-AE48-RP11-AE864

A group of highly expressed native E. coli proteins described by Ishihama Y. et al, BMC Genomics 2008, 9:102 were used to generate a list of the first 20 N-terminal amino acids (column 3 of Table 30), from which the hydrophobic amino acids F, I, W, L, V, M, C were converted to alanine or serine, or were deleted in order to generate candidates to create helper sequences containing at least 11 amino acids (column 4 of Table 30). For comparative purposes, the first 20 amino acids of a known CBD sequence from a well expressed construct built at Amunix (AC616) was also included as a control.

TABLE 30

List of N-terminal helpers designed in the study

| Plasmid | Protein description | 1st 20 aa | SEQ ID NO: | N-term Helpers | SEQ ID NO: |
|---|---|---|---|---|---|
| pSD0107 | 30S ribosomal protein S9 | MAENQYYGTG RRKSSAARVF | 987 | MAENQYYGTG RRKSSAAR | 999 |
| pSD0108 | 50S ribosomal protein L32 | MAVQQNKPTR SKRGMRRSHD | 988 | MAAQQNKPTR SKRGARRSHD | 1000 |
| pSD0109 | 30S ribosomal protein S20 | MANIKSAKKR AIQSEKARKH | 989 | MANAKSAKKR AAQSEKARKH | 1001 |
| pSD0110 | GrpE protein HSP-70 cofactor | MSSKEQKTPE GQAPEEIIMD | 990 | MSSKEQKTPE GQAPEE | 1002 |
| pSD0111 | 30S ribosomal protein S14 | MAKQSMKARE VKRVALADKY | 991 | MAKQSAKARE AKRAASADKY | 1003 |
| pSD0112 | 30S ribosomal protein S12 | MATVNQLVRK PRARKVAKSN | 992 | MATANQAARK PRARKAAKSN | 1004 |
| pSD0113 | Elongation factor Tu (EF-Tu) (P-43) | MSKEKFERTK PHVNVGTIGH | 993 | MSKEKAERTK PHANAGT | 1005 |
| pSD0114 | 30S ribosomal protein S15 | MSLSTEATAK IVSEFGRDAN | 994 | MSASTEATAK AASEAGRDAN | 1006 |
| pSD0115 | Superoxide dismutase [Mn] (EC 1.15.1.1) (MnSOD) | MSYTLPSLPY AYDALEPHFD | 995 | MSYTAPSAPY AYDAAEPH | 1007 |
| pSD0116 | rraB ribonuclease E inhibitor protein B | MANPEQLEEQ REETRLIIEE | 996 | MANPEQAEEQ REETR | 1008 |
| pSD0117 | Cellulose Binding Protein (CBD) | MANTPVSGNL KVEFYNSNPS | 997 | MANTPASGNA KAEAYNSNPS | 1009 |
| pSD0118 | CBD (from previous construct AC616) | MANTPVSGNL KVEFYNSNPS | 998 | MANTPVSGNL KVEFYNSNPS | 1010 |

DNA oligonucleotides for the 107N-F&R to 119N-F&R series and RP11F&R sequences of Table 31 were synthesized at Elim Biopharm (Hayward, Calif.). Solutions of each DNA pair (107N-F and 107N-R, 108N-F and 108N-R, etc) was mixed at a 1:1 molar ratio, were denatured at 95° C. for 3 min, followed by cooling to 25° C. at 0.1° C./min to allow double strand DNA annealing. The base vector LCW0970.030 (encoding CBD-AE864-GFP) was digested with NdeI/BsaI and the larger fragment was gel-purified as the vector. The vector was ligated with the annealed oligos 107-118N-F&R and PNK treated annealed RP11F&R oligos, and the ligation products were transformed into *E. coli* BL21 competent cells (New England Biolabs) to obtain the colonies designated pSD0107 to pSD118. The clones pSD0107-109, pSD0111-112, and pSD0114-118 were obtained and verified by DNA sequencing; clone pSD0110.001 had one mutation of frame-shift and was used as the stuffer vector.

The plasmid construct pCW1110 (encoding RP11-AE864) was digested with BsaI/NotI and the smaller band of corresponding to the nucleotides encoding AE864 was gel-purified as the insert. pCW1139 (encoding MalEss-AE48-payload-AE864) was digested by XhoI/BstXI/NotI and the larger fragment was gel-purified as the vector. The annealed product of oligos of 119-AEN-F&R was ligated with the insert and vector, and then transformed into *E. coli* BL21 to obtain colonies with the plasmid, designated pSD0119. The clones were sequence verified.

2. Construction of N-Term Helper Libraries Based on pSD0116

DNA oligonucleotide pairs of Stuffer-RP5for & Stuffer-RP5revP, RP6-SASRSAforP & RP6-SASRSArev, L2for & L2rev, L3for & L3rev, L4for & L4rev, L5for & L5rev, L6for & L6rev, L7for & L7rev, L8for & L8rev, L9for & L9rev, L10for & L10rev, L11for & L11rev, L12for & L12rev, and L13for & L13rev (Table 31) were synthesized at Elim Biopharm (Hayward, Calif.) and each pair was annealed as described above (Section 1) to generate double strand DNA.

Plasmid pSD0110 was digested with NdeI/BsaI and the larger fragment was gel-purified as the vector. The vector was ligated with annealed oligos of Stuffer-RP5for&revP and RP6-SASRSAforP&rev, and then transformed into *E. coli* BL21 to obtain the colonies with the stuffer vector plasmid pCW1146 (Stuffer-RP11-XTEN_AE864_003-GFP). The clone was sequence verified.

The NdeI/BsaI digested pSD0110 vector was ligated with L5for&rev annealed oligos to obtain colonies of LCW1160 (L5).

The stuffer vector pCW1146 was digested with NdeI/BsaI and the larger fragment was gel-purified as the vector. The vector was ligated with annealed oligos of L2-4, and L6-13 for&rev as in Table 31, and then transformed into *E. coli* BL21 to obtain the colonies of constructs LCW1157 (L2), LCW1158 (L3), LCW1159 (LA), LCW1163 (L6), LCW1171 (L7), LCW1172 (L8), LCW1203 (L9), LCW1204 (L10), LCW1208 (L11), LCW1209 (L12), and LCW1210 (L13).

TABLE 31

List of DNA oligonucleotides

| Name | DNA Sequence | SEQ ID NO: |
|---|---|---|
| RP11F | CGTCCGCGTCCTCGCCCACGTCCACGTCCGCGTCC ACGCCCTCGTCCTCGTCCGCGCCCTCGTCCGagcg cgtctcgttccgctGGGTCTCC | 1011 |
| RP11R | ACCTGGAGACCCAGCGGAACGAGACGCGCTCGGAC GAGGGCGCGGACGAGGACGAGGGCGTGGACGCGGA CGTGGACGTGGGCGAGGACGCG | 1012 |
| 107N-F | TATGGCTGAAAATCAATATTATGGTACGGGGCGCC GGAAGAGTTCGGCCGCC | 1013 |
| 107N-R | GACGGGCGGCCGAACTCTTCCGGCGCCCCGTACCA TAATATTGATTTTCAGCCA | 1014 |
| 108N-F | TATGGCAGCTCAGCAGAATAAGCCTACACGAAGTA AAAGAGGCGCGCGCCGGTCGCACGAT | 1015 |
| 108N-R | GACGATCGTGCGACCGGCGCGCGCCTCTTTTACTT CGTGTAGGCTTATTCTGCTGAGCTGCCA | 1016 |
| 109N-F | TATGGCAAATGCTAAGAGTGCAAAGAAACGGGCGG CACAAAGCGAAAAAGCTCGGAAACAT | 1017 |
| 109N-R | GACGATGTTTCCGAGCTTTTTCGCTTTGTGCCGCC CGTTTCTTTGCACTCTTAGCATTTGCCA | 1018 |
| 110N-F | TATGTCCAGCAAAGAACAGAAGACTCCGGAAGGTC AAGCGCCAGAGGAG | 1019 |
| 110N-R | GACGCTCCTCTGGCGCTTGACCTTCCGGAGTCTTC TGTTCTTTGCTGGACA | 1020 |
| 111N-F | TATGGCCAAACAAAGCGCTAAAGCCCGCGAGGCGA AACGTGCAGCCTCTGCGGACAAATAT | 1021 |
| 111N-R | GACGATATTTGTCCGCAGAGGCTGCACGTTTCGCC TCGCGGGCTTTAGCGCTTTGTTTGGCCA | 1022 |

TABLE 31-continued

List of DNA oligonucleotides

| Name | DNA Sequence | SEQ ID NO: |
|---|---|---|
| 112N-F | TATGGCTACTGCAAATCAGGCCGCCCGTAAACCTC GAGCACGAAAGGCTGCTAAATCAAAT | 1023 |
| 112N-R | GACGATTTGATTTAGCAGCCTTTCGTGCTCGAGGT TTACGGGCGGCCTGATTTGCAGTAGCCA | 1024 |
| 113N-F | TATGTCCAAAGAAAAAGCCGAACGGACCAAACCTC ATGCTAACGCTGGCACG | 1025 |
| 113N-R | GACGCGTGCCAGCGTTAGCATGAGGTTTGGTCCGT TCGGCTTTTTCTTTGGACA | 1026 |
| 114N-F | TATGTCAGCGTCTACGGAGGCAACCGCAAAAGCTG CTAGTGAAGCGGGCCGTGATGCGAAT | 1027 |
| 114N-R | GACGATTCGCATCACGGCCCGCTTCACTAGCAGCT TTTGCGGTTGCCTCCGTAGACGCTGACA | 1028 |
| 115N-F | TATGAGCTATACTGCACCGAGCGCACCGTATGCTT ATGATGCAGCCGAACCTCAC | 1029 |
| 115N-R | GACGGTGAGGTTCGGCTGCATCATAAGCATACGGT GCGCTCGGTGCAGTATAGCTCA | 1030 |
| 116N-F | TATGGCAAACCCCGAACAGGCTGAGGAACAGAGAG AAGAAACA | 1031 |
| 116N-R | GACGTGTTTCTTCTCTCTGTTCCTCAGCCTGTTCG GGGTTTGCCA | 1032 |
| 117N-F | TATGGCTAATACCCCTGCGAGCGGGAACGCCAAGG CGGAAGCTTACAACAGTAATCCAAGC | 1033 |
| 117N-R | GACGGCTTGGATTACTGTTGTAAGCTTCCGCCTTG GCGTTCCCGCTCGCAGGGGTATTAGCCA | 1034 |
| 118N-F | TATGGCAAATACACCGGTATCAGGCAATTTGAAGG TTGAATTCTACAACAGCAATCCTTCA | 1035 |
| 118N-R | GACGTGAAGGATTGCTGTTGTAGAATTCAACCTTC AAATTGCCTGATACCGGTGTATTTGCCA | 1036 |
| 119-AEN-F | TCGAGCACGGGCAGCCCA | 1037 |
| 119-AEN-R | GACGTGGGCTGCCCGTGC | 1038 |
| Stuffer-RP5for | TATGggctgaGGGTCTCaCGTCCGCGTCCTCGCCC ACGTCCACGTCCGCGT | 1039 |
| Stuffer-RP5revP | GGACGTGGACGTGGGCGAGGACGCGGACGtGAGAC CCtcagccCA | 1040 |
| RP6-SASRSAforP | CCACGCCCTCGTCCTCGTCCGCGCCCTCGTCCGag cgcgtctcgttccgc | 1041 |
| RP6-SASRSArev | ACCTgcggaacgagacgcgctCGGACGAGGGCGCG GACGAGGACGAGGGCGTGGACGC | 1042 |
| L2for | tATGaaaAAYCCNGARCARGCNGARGARCARMGYG ARGARACa | 1043 |
| L2rev | GACGTGTYTCYTCRCKYTGYTCYTCNGCYTGYTCN GGRTTTTTCA | 1044 |
| L3for | tATGGCNAAYCCNGARCARGCNGARGARCARMGYG ARGARACa | 1045 |
| L3rev | GACGTGTYTCYTCRCKYTGYTCYTCNGCYTGYTCN GGRTTNGCCA | 1046 |
| L4for | tATGaaaAAcCCVGARCARGCDGARGAaCARGCDG ARGAaCAgMGYGAaGARACa | 1047 |

TABLE 31-continued

List of DNA oligonucleotides

| Name | DNA Sequence | SEQ ID NO: |
|---|---|---|
| L4rev | GACGTGTYTCTTCRCKCTGTTCYTCHGCYTGTTCY TCHGCYTGYTCBGGGTTTTTCA | 1048 |
| L5for | tATGaRaCCNCGNCCNCGNCCNCGNCCNCGNCCNC GNCCNCGNCCNCGNCCNCGNCCNCGNCCNCGNCCN GGGTCTCC | 1049 |
| L5rev | ACCTGGAGACCCNGGNCGNGGNCGNGGNCGNGGNC GNGGNCGNGGNCGNGGNCGNGGNCGNGGNCGNGGN CGNGGTYTCA | 1050 |
| L6for | tATGaaaAAHMMVGARCARGCWGARGAaCARGCDG ARGAaCAgMGYGAaGARACa | 1051 |
| L6rev | GACGTGTYTCTTCRCKCTGTTCYTCHGCYTGTTCY TCWGCYTGYTCBKKDTTTTTCA | 1052 |
| L7for | tATGAAAAAWCAMRARMARRMWRAARAAMAARMDR AARAACAGMGCGAAGARACA | 1053 |
| L7rev | GACGTGTYTCTTCGCKCTGTTYTTYHKYTTKTTYT TYWKYYTKYTYKTGWTTTTTCA | 1054 |
| L8for | tATGAAAAAWCAMRARMARRMWRAARAAMAAGCDG AAGAACAGMGCGAAGARACA | 1055 |
| L8rev | GACGTGTYTCTTCGCKCTGTTCTTCHGCTTKTTYT TYWKYYTKYTYKTGWTTTTTCA | 1056 |
| L9for | tATGAAAAANCMMGAACAAGAARAARAAMAAGCNG AAGAACARCGYGARGARACA | 1057 |
| L9rev | GACGTGTYTCYTCRCGYTGTTCTTCNGCTTKTTYT TYTTCTTGTTCKKGNTTTTCA | 1058 |
| L10for | tATGAAAAANCMMGAACAAGAARAARAAMAAGCNG AAGAAMARMRHRARRARAMA | 1059 |
| L10rev | GACGTKTYTYYTYDYKYTKTTCTTCNGCTTKTTYT TYTTCTTGTTCKKGNTTTTCA | 1060 |
| L11for | tATGAAAAACAAGAACAAGAAAAAGAACAAGCGG AAGAACAAKCNVARKCNVARCGTGAGGAGACA | 1061 |
| L11rev | GACGTGTCTCCTCACGYTBNGMYTBNGMTTGTTCT CTCCGCTTGTTCTTTTCTTGTTTGTTTTTCA | 1062 |
| L12for | tATGAAAAAACAAGAACAAGAAAAAGAACAAGCGG AAGAACAAKCVVAAKCVVAAKCVVAAKCVVAACGT GAGGAGACA | 1063 |
| L12rev | GACGTGTCTCCTCACGTTBBGMTTBBGMTTBBGMT TBBGMTTGTTCTTCCGCTTGTTCTTTTCTTGTTC TTGTTTTTCA | 1064 |
| L13for | tATGAAAAACAAGAACAAGAAAAAGAACAAGCGG AAGAACAANNNNNNNNNNNNNCGTGAGGAGACA | 1065 |
| L13rev | GACGTGTCTCCTCACGNNNNNNNNNNNNNTTGTTCT TCCGCTTGTTCTTTTCTTGTTCTTGTTTTTTCA | 1066 |

3. Screening and Analysis of the N-Terminal Helper Libraries LCW1157-1159

Figure 81:
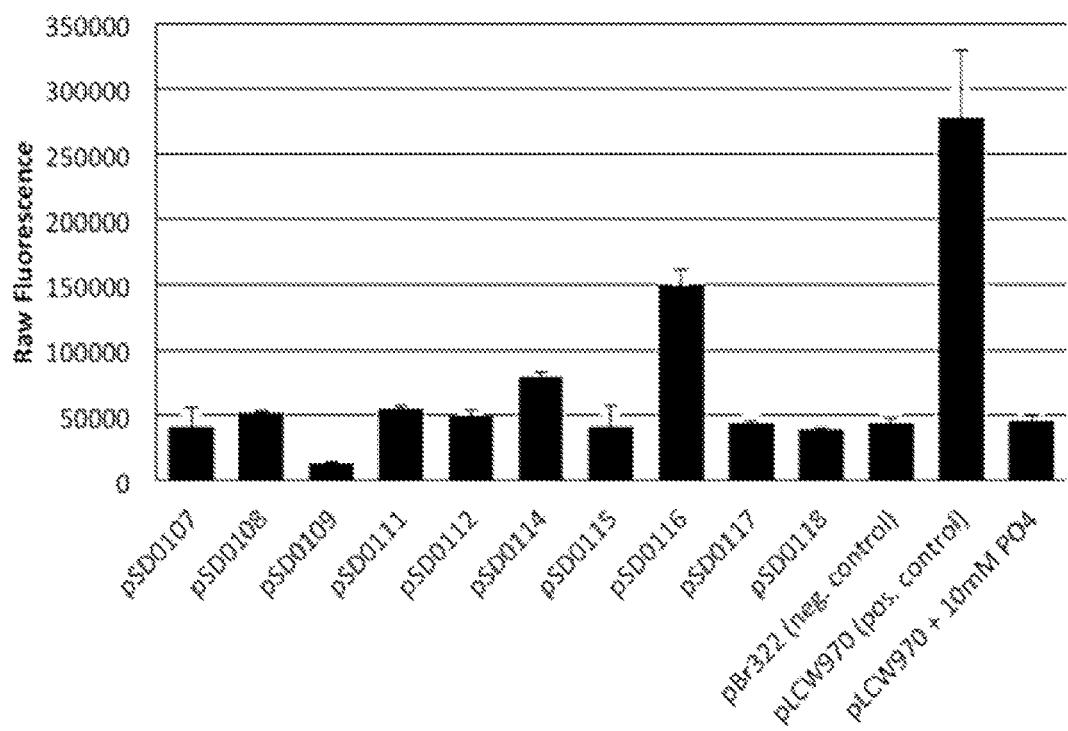
FIG. 81 provides the results of the assay to measure the fluorescence signal of RP11 clones pSD0107 to pSD0118), as described in Example 12. One positive control (pLCW970) and two negative controls (pBr322 and pLCW970+10 mM phosphate) were included. The GFP expression level was measured using samples from 2-3 shake flasks per construct.

E. coli hosts transformed with the plasmids pSD107 to pSD0118 were expressed in shake flasks and the expression levels in each were evaluated by measuring the fluorescence from the C-terminal GFP reporter. Briefly, an overnight culture was grown for each construct in SB media (with 12.5 μg/ml tetracycline), which was then used to inoculate a 200 ml culture of PhoA phosphate depletion autoinduction media with 12.5 μg/ml tetracycline (3 shake flasks were grown for each construct). After growing at 26° C. with 225 rpm for 48 h, 100 μl aliquot was taken from each culture and the GFP expression level was measured with a fluorescence plate reader with excitation wavelength of 395 nm and emission wavelength of 510 nm. Two readings were taken for each shake flask. Among the constructs tested, pSD0116 had the highest fluorescence signal, followed by pSD0114 (FIG. 81), but the expression levels of these two constructs were significantly lower than the LCW0970.030 (pLCW970) positive control.

In order to further improve expression, three libraries (LCW1157, 1158, and 1159) were built based on pSD0106, and were screened in a high through-put format. Large numbers of colonies from these libraries (Table 32) were picked to grow individually in 500 μl SB media (with 12.5 μg/ml tetracycline) in 96 deep well plates overnight at 37° C. shaking with 300 rpm. 20 μl of the saturated culture was used to inoculate 500 μl of PhoA phosphate depletion autoinduction media (with 12.5 μg/ml tetracycline) in 96 deep well plates that were incubated at 26° C. shaking with 300 rpm for 22-24 h. Expression was then determined by placing 100 μl of the culture into a 96 well plate measuring the fluorescence from the C-terminal GFP reporter.

After evaluation of the fluorescence signal, the six highest expression clones and two low expression clones were chosen from each 96 deep well plate tested and the expression of these clones were tested again with 4 replicates. For all three libraries, clones having higher expression than the pSD0116 construct were identified (FIG. 82A-C), and the correlation between the original tests and retests was good (FIG. 82D-F). Among the 3 libraries tested, library LCW1159 gave higher expression level in general, and the highest expression construct from this round of screening (LCW1159.004) came from this library.

Figure 83:
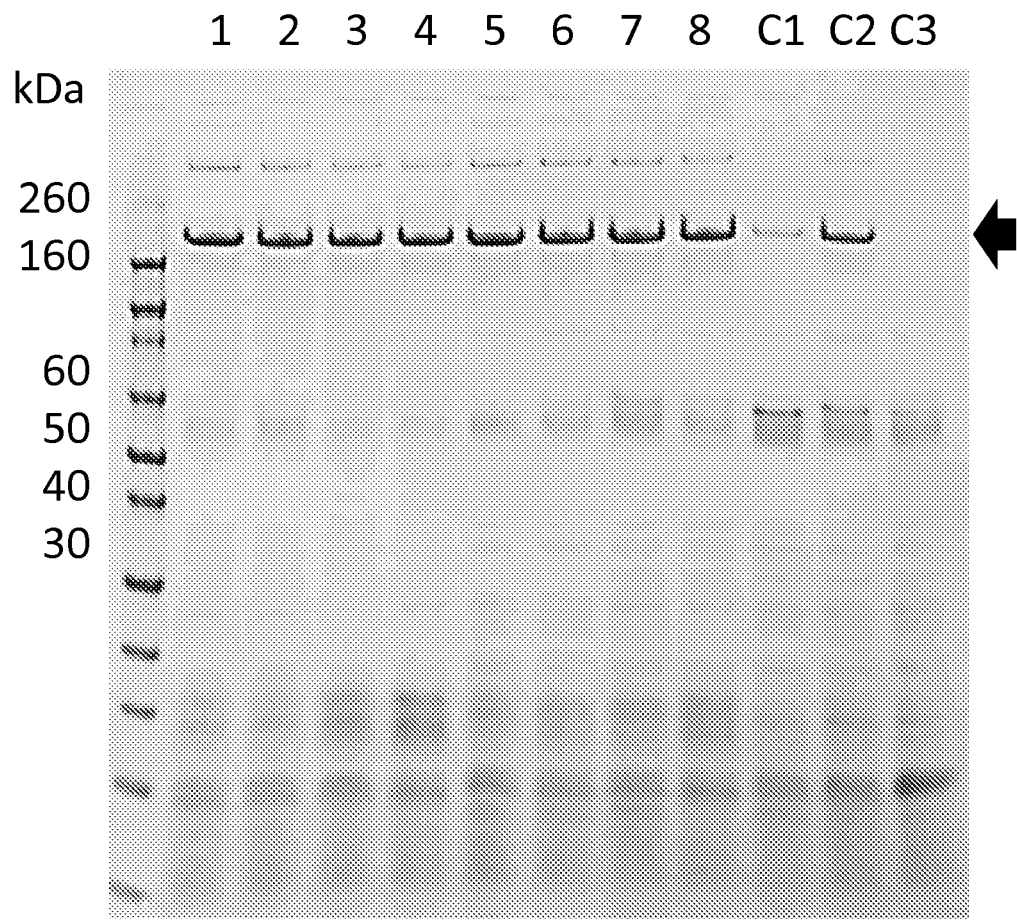
FIG. 83 shows results of the SDS-PAGE analysis of the top 8 expression construct products and controls under unreduced conditions, as described in Example 12. The desired full length protein end product RP11-XTEN-GFP is indicated by an arrow, and the higher band is the dimer of the protein. Lanes: 1-8: top 8 expression constructs (expression level from high to low, based on fluorescence reading of the retests), 1. LCW159.004, 2. LCW159.006, 3. LCW1158.004, 4. LCW157.040, 5. LCW1158.003, 6. LCW157.039, 7. LCW1157.025, 8. LCW1157.038; C1-C3: Controls: C1. pSD0114, C2. pSD0116, C3. pCW1146 (Negative control).
Figure 84:
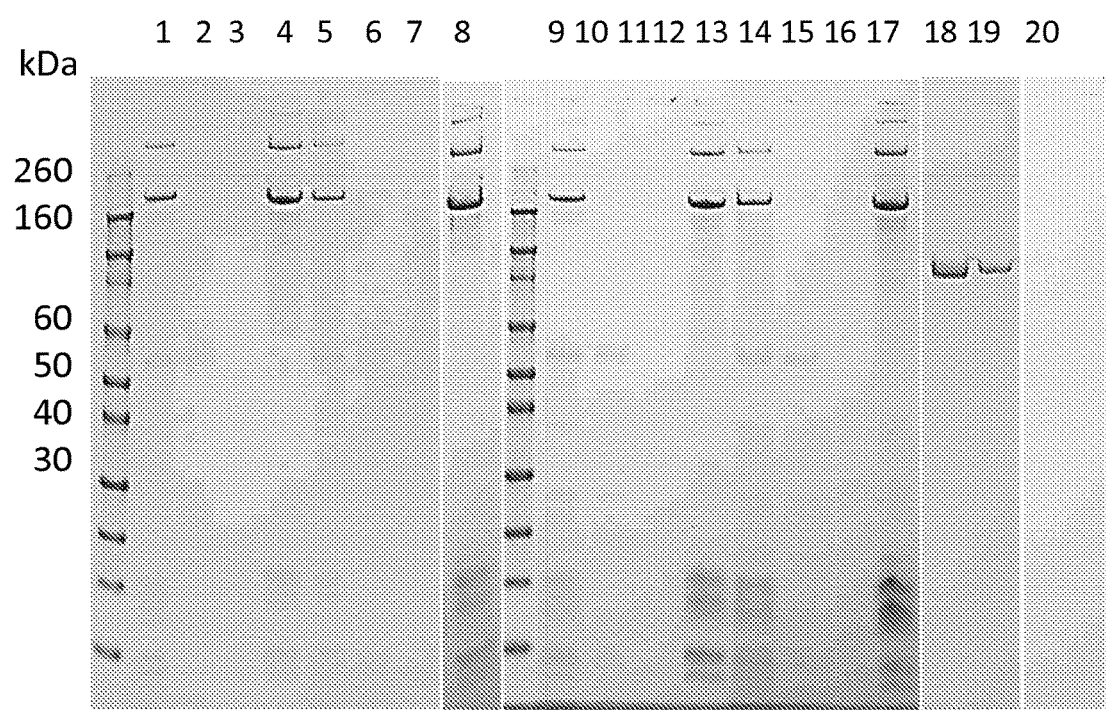
FIG. 84 shows the SDS-PAGE evaluation of the MacroCap SP capture efficiency for the top 4 expression construct products under non-reducing conditions, as described in Example 12. Lanes 1-4: load, flow through, wash and elution of LCW1159.004, 2. Lanes 5-8: load, flow through, wash and elution of LCW1159.006. Lanes 9-12: load, flow through, wash and elution of LCW1158.004. 13-16: load, flow through, wash and elution of LCW157.040. Lanes 17-20 1-4: load, flow through, wash and elution of negative control. Unmarked lanes are molecular weight standards.

The 8 constructs with the highest expression levels from these three libraries and controls were treated with Pop Culture (EMD Millipore), were heat treated, and the resulting lysates were analyzed with SDS-PAGE/Coomassie staining (FIG. 83). Expression levels of the 8 constructs were confirmed to be higher than controls (negative control, LSD0114 and LSD0116), and full-length proteins were produced from these constructs. Lysates of 4 top expression constructs (after Pop Culture and heat treatment) and a negative control (AP32, a purified XTEN-GFP protein without RP11 tag) were each loaded onto a MacroCap SP column at pH of 8 and conductivity of 6.5 mS/cm. The column was washed with 20 mM sodium phosphate, pH 8, 100 mM NaCl, and the protein was eluted with 20 mM sodium phosphate, pH 8, 500 mM NaCl. The samples of the load, flow through, wash and elutate were analyzed by SDS-PAGE gel (FIG. 84). The results demonstrated that the expression protein of the four, which came from all three libraries, can be captured by MacroCap SP; thus the binding was contributed to the presence of the RP11 tag in the protein since the negative control (not containing the RP11 tag) didn't bind to the MacroCap SP column.

The plasmids of the clones chosen for retests were minipreped and the DNA sequences of the N-terminal helpers were analyzed. Codon bias was observed at several locations (Table 33). For example, the 3rd amino acid of LCW1157, N, is encoded by AAC or AAT. Most of the high expression clones (77%) in LCW1157 are encoded by AAT at the 3rd amino acid, while most of the low expression clones (88%) are encoded by AAC, indicating AAT is preferred over AAC at this position for high expression. Similarly, CCG is preferred at the 4th amino acid, while GCG at the 7th amino acid is accumulated in low expression clones. These trends were also observed in libraries LCW1158 and LCW1159, as well.

TABLE 32

Libraries LCW1157-1159

| Library | Description | N-terminal helper sequence (DNA) | Diversity | Number Screened |
|---|---|---|---|---|
| LCW 1157 | Codon optimize helper sequence, Change 2$^{nd}$ codon to Lys (AAA) | ATGaaaAAY(C/T)CCN(A/G/C/T) GAR(A/G)CAR(A/G)GCN (A/C/T/G)GAR(A/G)GAR(A/G) CAR(A/G)M(A/C)GY(C/T)GA R(A/G)GAR(A/G)ACa (SEQ ID NO: 1067) | 98304 | 406 |
| LCW 1158 | Codon optimize helper sequence | ATGGCN(A/G/C/T)AAY(C/T) CCN(A/G/C/T)GAR(A/G)CAR (A/G)GCN(A/G/C/T)GAR(A/G) GAR(A/G)CAR(A/G)M(A/C) GY(C/T)GAR(A/G)GAR(A/G) ACa (SEQ ID NO: 1068) | 393216 | 85 |
| LCW 1159 | Insert AEEQ into helper sequence, Use fewer codons than LCW1157 to keep diversity manageable | ATGaaaAAcCCV(A/G/C)GAR (A/G)CAR(A/G)GCD(A/G/T) GAR(A/G)GAaCAR(A/G)GC D(A/G/T)GAR(A/G)GAaCAg M(A/C)GY(C/T)GAaGAR(A/G) ACa (SEQ ID NO: 1069) | 20736 | 146 |

TABLE 33

Analysis of sequence results of high and low expression clones in libraries LCW1157-1159*

LCW1157

| amino acid# | | 2 K (AAA) | 3 N (AA+) | 4 P (CC+) | 5 E (GA+) | 6 Q (CA+) | 7 A (GC+) | 8 E (GA+) | 9 E (GA+) | 10 Q (CA+) | 11 R or S (+G+) | 12 E (GA+) | 13 E (GA+) | 14 T (AC+) |
|---|---|---|---|---|---|---|---|---|---|---|---|---|---|---|
| codon | | | 3rd | 3rd | 3rd | 3rd | 3rd | 3rd | 3rd | 3rd | 1st | 3rd | 3rd | 3rd |
| high total: 30 | A | K (AAA) | 0% | 10% | 57% | 67% | 33% | 80% | 70% | 50% | 30% | 63% | 57% | T (ACA) |
| | G | | 0% | 43% | 43% | 33% | 7% | 20% | 30% | 50% | 0% | 37% | 43% | |
| | C | | 23% | 23% | 0% | 0% | 47% | 0% | 0% | 0% | 70% | 0% | 0% | |
| | T | | 77% | 23% | 0% | 0% | 13% | 0% | 0% | 0% | 0% | 0% | 0% | |
| low total: 8 | A | | 0% | 13% | 88% | 50% | 25% | 38% | 63% | 25% | 63% | 75% | 63% | |
| | G | | 0% | 13% | 13% | 50% | 63% | 63% | 38% | 75% | 0% | 25% | 38% | |
| | C | | 88% | 0% | 0% | 0% | 0% | 0% | 0% | 0% | 38% | 0% | 0% | |
| | T | | 13% | 75% | 0% | 0% | 13% | 0% | 0% | 0% | 63% | 0% | 0% | |

LCW1158:

| amino acid# | | 2 A (GC+) | 3 N (AA+) | 4 P (CC+) | 5 E (GA+) | 6 Q (CA+) | 7 A (GC+) | 8 E (GA+) | 9 E (GA+) | 10 Q (CA+) | 11 R or S (+G+) | 12 E (GA+) | 13 E (GA+) | 14 T (AC+) |
|---|---|---|---|---|---|---|---|---|---|---|---|---|---|---|
| codon | | 3rd | 3rd | 3rd | 3rd | 3rd | 3rd | 3rd | 3rd | 3rd | 1st | 3rd | 3rd | 3rd |
| high total: 6 | A | 83% | 0% | 33% | 17% | 67% | 50% | 83% | 50% | 83% | 83% | 0% | 50% | T (ACA) |
| | G | 0% | 0% | 0% | 83% | 33% | 0% | 17% | 50% | 17% | 0% | 0% | 50% | |
| | C | 0% | 33% | 33% | 0% | 0% | 33% | 0% | 0% | 0% | 17% | 100% | 0% | |
| | T | 17% | 67% | 33% | 0% | 0% | 17% | 0% | 0% | 0% | 0% | 0% | 0% | |
| low total: 2 | A | 100% | 0% | 0% | 100% | 100% | 0% | 100% | 100% | 100% | 100% | 0% | 100% | |
| | G | 0% | 0% | 100% | 0% | 0% | 100% | 0% | 0% | 0% | 0% | 100% | 0% | |
| | C | 0% | 0% | 0% | 0% | 0% | 0% | 0% | 0% | 0% | 0% | 0% | 0% | |
| | T | 0% | 100% | 0% | 0% | 0% | 0% | 0% | 0% | 0% | 0% | 0% | 0% | |

LCW1159:

| amino acid# | | 2 K (AAA) | 3 N (AAC) | 4 P (CC+) | 5 E (GA+) | 6 Q (CA+) | 7 A (GC+) | 8 E (GA+) | 9 E (GA+) | 10 Q (CA+) | 11 A (GC+) | 12 E (GA+) | 13 E (GA+) | 14 Q (CA+) | 15 R or S (+G+) | 16 E (GA+) | 17 E (GA+) | 18 T (AC+) |
|---|---|---|---|---|---|---|---|---|---|---|---|---|---|---|---|---|---|---|
| codon | | | | 3rd | 3rd | 3rd | 3rd | 3rd | 3rd | 3rd | 3rd | 3rd | 3rd | 1st | 3rd | 3rd | 3rd | 3rd |
| high total: 12 | A | K (AAA) | N (AAC) | 42% | 67% | 67% | 50% | E(GAA) | E(GAA) | 67% | 58% | E(GAA) | Q(CAG) | 25% | 0% | E(GAA) | 58% | T(ACA) |
| | G | | | 17% | 33% | 33% | 0% | | | 33% | 42% | | | 0% | 0% | | 42% | |
| | C | | | 42% | 0% | 0% | 50% | | | 0% | 0% | | | 75% | 75% | | 0% | |
| | T | | | 0% | 0% | 0% | 0% | | | 0% | 0% | | | 0% | 25% | | 0% | |
| low total: 3 | A | | | 33% | 100% | 67% | 100% | | | 67% | 100% | | | 33% | 0% | | 33% | |
| | G | | | 33% | 0% | 33% | 0% | | | 33% | 0% | | | 0% | 0% | | 67% | |
| | C | | | 33% | 0% | 0% | 0% | | | 0% | 0% | | | 67% | 67% | | 0% | |
| | T | | | 0% | 0% | 0% | 0% | | | 0% | 0% | | | 0% | 33% | | 0% | |

*The total numbers of high and low expression clones analyzed are specified for each library, and the percentages of A, G, C, or T in each of the location where the codon was varied were analyzed.

4. Screening and Analysis of the N-Terminal Helper Library LCW1163

Figure 85:
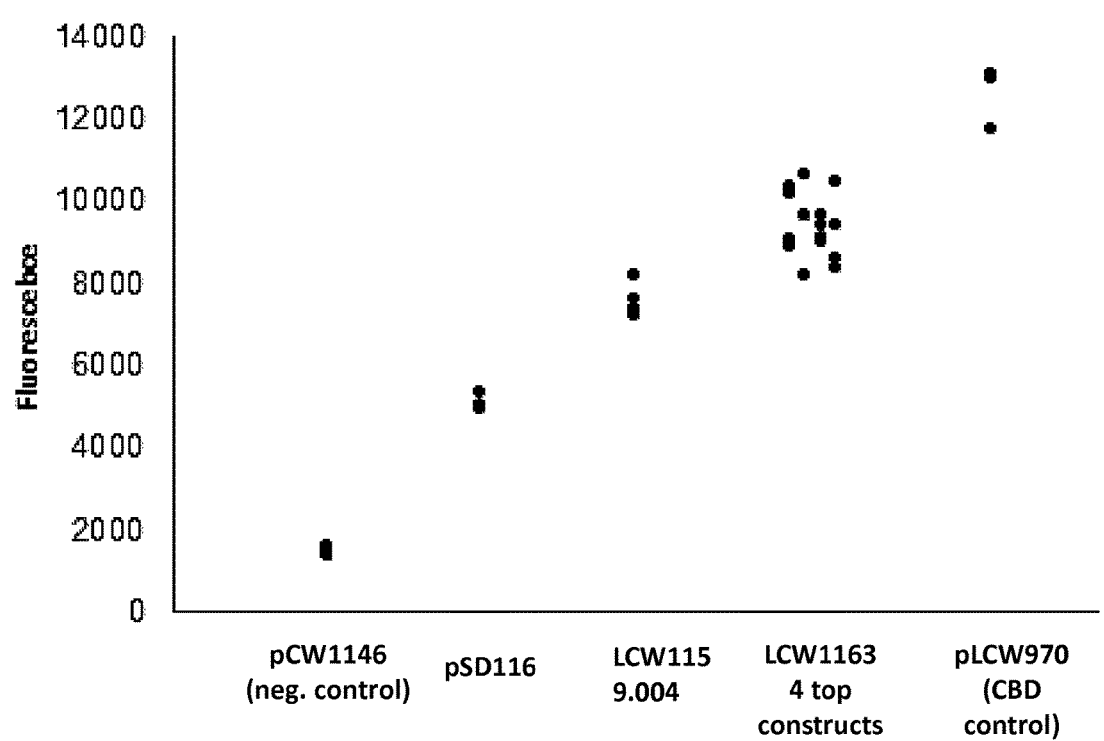
FIG. 85 shows the summary of library LCW1163 screening results with a comparison of the fluorescence signal of the top 4 expression products and the controls in the retests, as described in Example 12. Each sample had 4 replicates, represented by 4 individual dots in the figure.

Since library LCW1159 had generally higher expression than LCW1157 and LCW1158, the next library design was based on LCW1159, with the introduction of more variants in the N-terminal helper domain coding region. A total of 672 clones from this library (theoretical diversity of 55296) was screened and retested in the same way as libraries LCW1157-1159. Clones with higher expression than LCW1159.004 (the highest from the previous round of screening) were observed (FIG. 85). The top expression clone, LCW163.029, achieved a 40% improvement from LCW1159.004, while its expression level was 27% lower than the CBD control. The sequence of the high and low expression clones were analyzed, and the preferred nucleotides for expression were identified and summarized (see Table 34). Most of the locations have shown a preference of codon A for high expression, while others have a preference for C.

TABLE 34

Analysis of sequence results of high and low expression clones in the library LCW1163*

| nucleotide number | | #9 | #10 | #11 | #12 | #15 | #18 | #21 | #24 | #30 | #33 | #36 | #43 | #45 | #51 |
|---|---|---|---|---|---|---|---|---|---|---|---|---|---|---|---|
| high expression | A | 74 | 17 | 74 | 40 | 37 | 40 | 66 | 77 | 60 | 43 | 66 | 40 | 0 | 34 |
| | C | 17 | 83 | 26 | 49 | 0 | 0 | 0 | 0 | 0 | 0 | 0 | 60 | 83 | 0 |
| | T | 9 | 0 | 0 | 0 | 0 | 0 | 34 | 0 | 0 | 29 | 0 | 0 | 17 | 0 |
| | G | 0 | 0 | 0 | 11 | 63 | 60 | 0 | 23 | 40 | 29 | 34 | 0 | 0 | 66 |
| low expression | A | 20 | 70 | 3 | 20 | 40 | 20 | 60 | 50 | 30 | 10 | 20 | 50 | 0 | 60 |
| | C | 60 | 30 | 70 | 30 | 0 | 0 | 0 | 0 | 0 | 0 | 0 | 50 | 50 | 0 |
| | T | 20 | 0 | 0 | 0 | 0 | 0 | 40 | 0 | 0 | 40 | 0 | 0 | 50 | 0 |
| | G | 0 | 0 | 0 | 50 | 60 | 80 | 0 | 50 | 70 | 50 | 80 | 0 | 0 | 40 |
| preferred | | A | C | A | A/C | | | A | A | | | A | | C | |

*The percentages of A, G, C, or T in each of the location where the codon was varied were analyzed, and the identified preferred nucleotides were summarized in the bottom row 5. Screening and analysis of the RP11 library LCW1160

Figure 86:
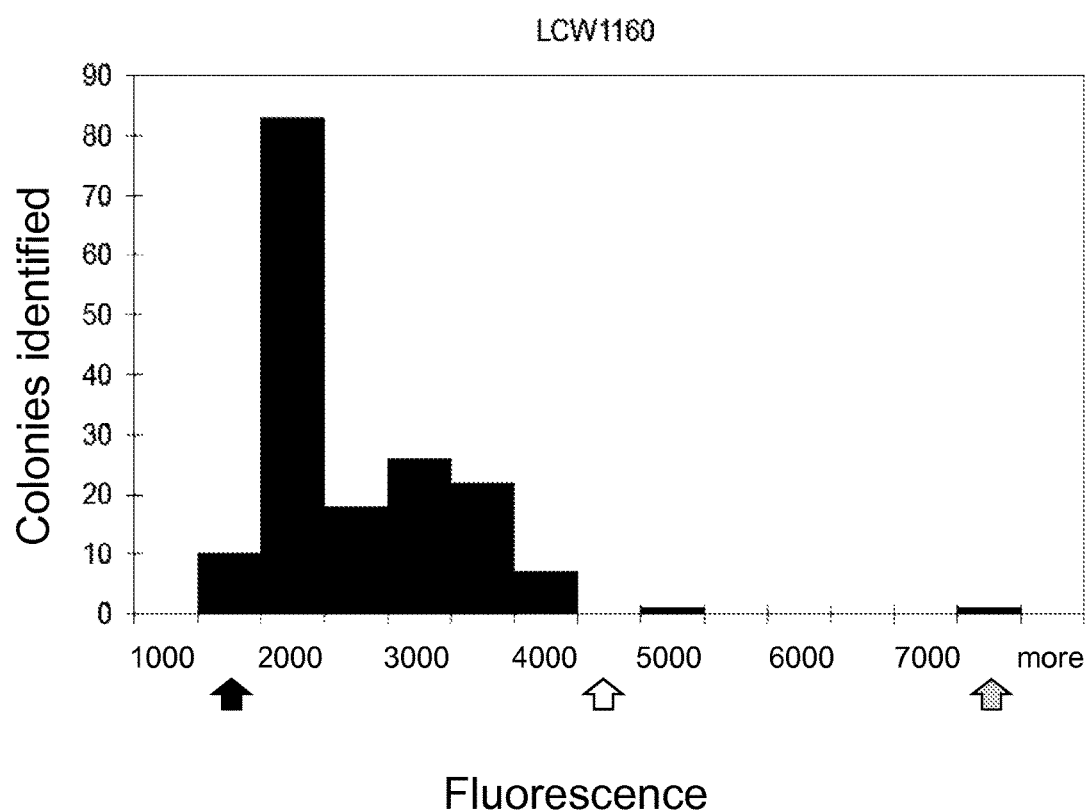
FIG. 86 shows the summary of library LCW1160 screening results, as described in Example 12. Fluorescence histogram of LCW157-1159, showing the number of colonies identified for each fluorescence signal region; average fluorescence reading of negative control (black arrow), pSD0116 (white arrow), and LCW1159.004 (high expression candidates from screening LCW1157-1159, grey arrow) were marked in the figures.

At the same time, 168 colonies from library LCW1160 (the library varying the coding region of RP11 tag without any N-terminal helper domain (total theoretical diversity of $8.8 \times 10^{12}$) were screened and analyzed. However, this library had very low expression level in general (FIG. 86), and the one outlier with high expression was found to encode a truncated RP11 tag after performing plasmid miniprep and DNA sequencing analysis. The screening results of the library, under these experimental conditions, strongly suggest that an N-terminal helper is required to achieve high expression levels.

6. Screening of the N-Terminal Helper Libraries LCW1171, LCW1172, LCW1203, and LCW1204.

Figure 94:
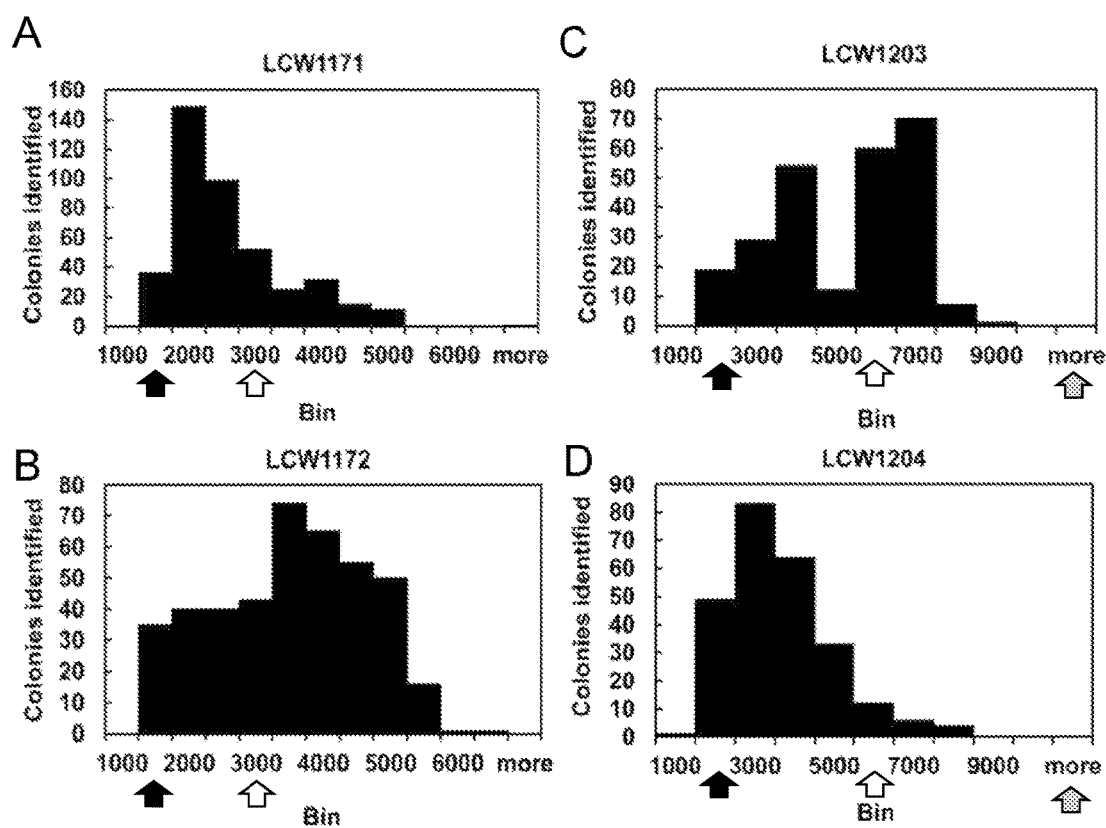
FIG. 94 shows the results of screening libraries LCW1171, 1172, 1203, and 1204, as described in Example 14.

More N-terminal libraries (LCW1171, LCW1172, LCW1203, and LCW1204) were screened and analyzed in the same way as those described above. LCW1171 and 1172 were designed similarly, while LCW1171 allowed more amino acid changes in the helper sequence than LCW1172. The screening results showed that LCW1171 in general had much lower expression level than LCW1172 (FIGS. 94A and B). LCW1203 and 1204 were designed similarly, focusing on randomizing a different region of the helper sequence compared with LCW1171 and 1172. LCW1204 allowed more amino acid changes than LCW1203, which resulted in lower expression than LCW1203 in general (FIGS. 94C and D). These results suggest that the expression level is sensitive to amino acid changes in the helper domain sequences.

7. Screening of the N-Terminal Helper Libraries LCW1208, LCW1209, and LCW1210.

Figure 95:
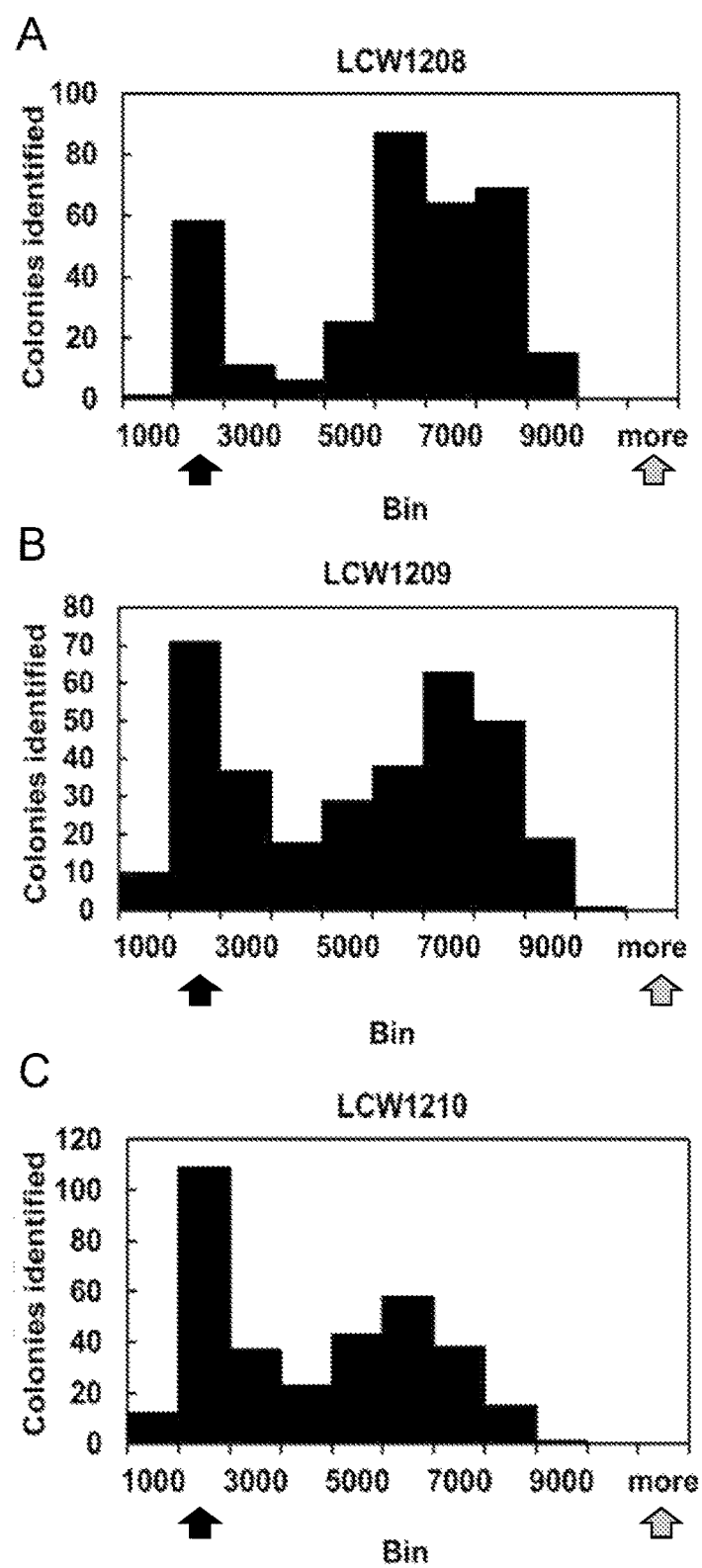
FIG. 95 shows the results of screening libraries LCW1208-1210, as described in Example 12.
Figure 97:
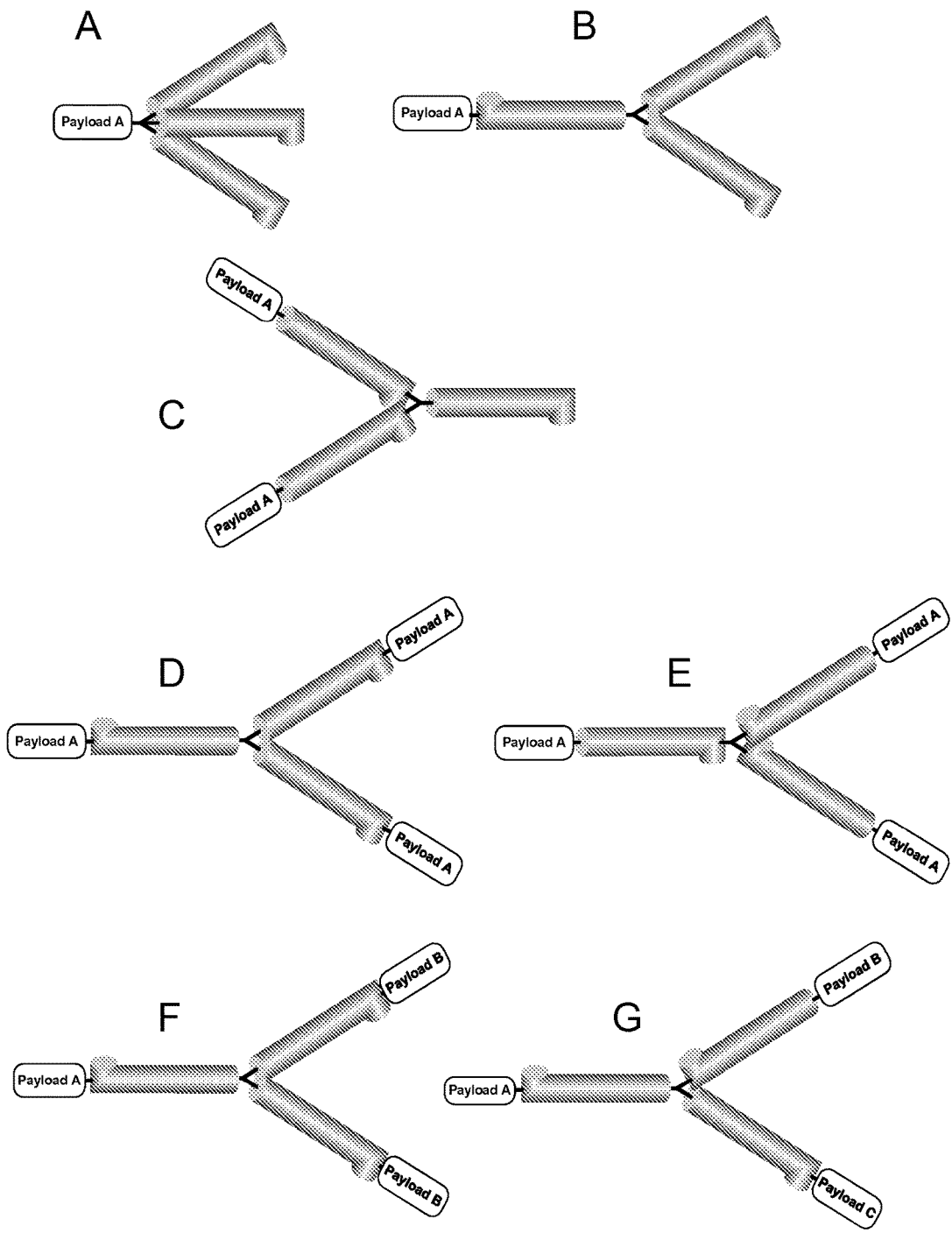
FIG. 97 illustrates different embodiments of trimeric, branched XTEN-payload conjugates in which all conjugates shown can be prepared from the identical XTEN molecules via conjugation to its N-terminal amino group and a functional group, such as the thiol of cysteine, that is located close to the C-terminus.
Figure 98:
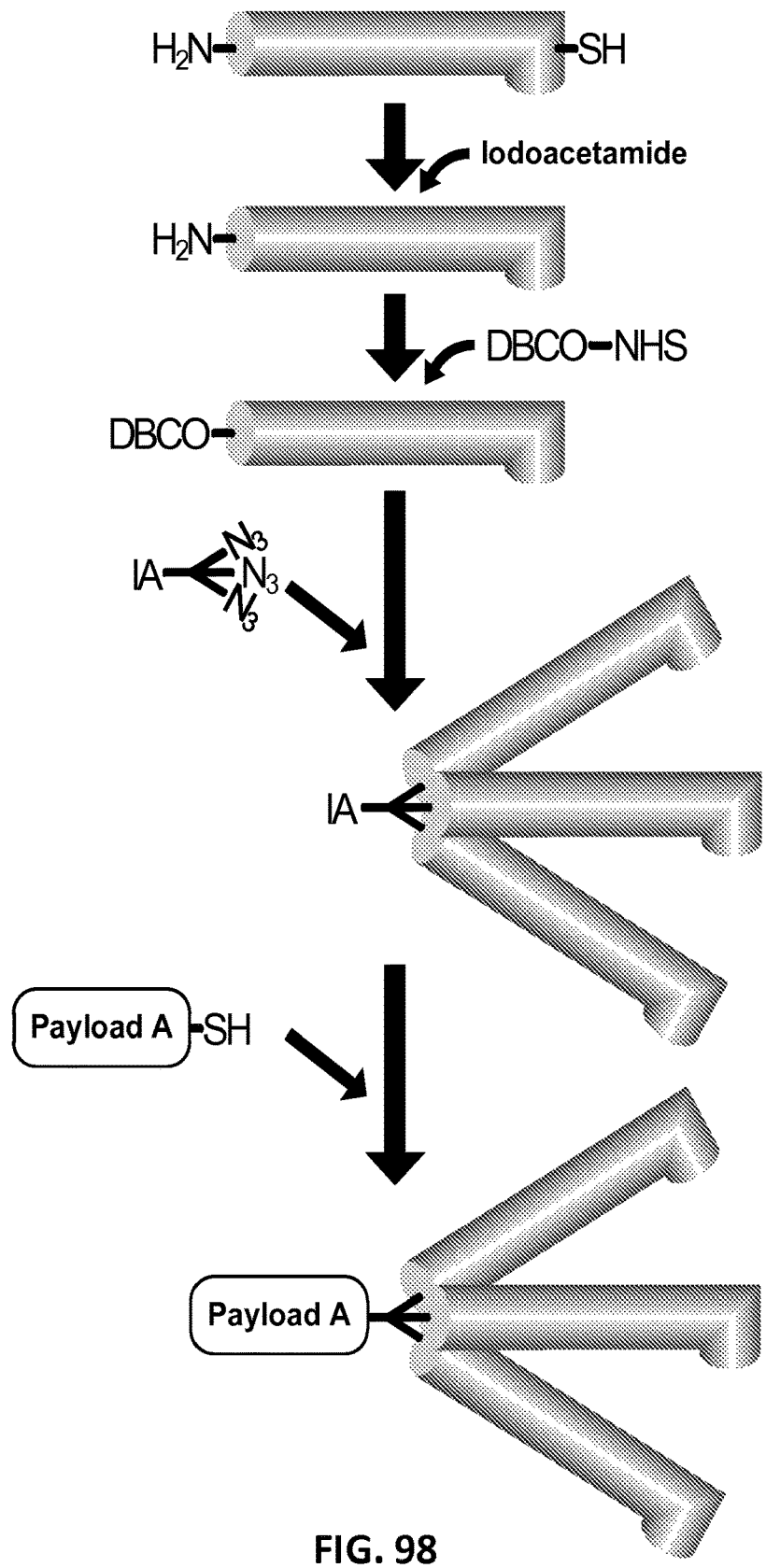
FIG. 98 illustrates a scheme for synthesis of a conjugate between a branched XTEN and a single payload molecule. Initially, the thiol group in XTEN is blocked by reaction with iodoacetamide (alternatively, one can start the synthesis using XTEN which lacks a thiol group). Next, a DBCO group is added to the alpha-amino group of XTEN, then is reacted with a tetrafunctional cross linker that comprises one iodoacetyl group and three azide groups. The resulting XTEN is next reacted with a payload that carries a free thiol group resulting in the final XTEN-payload conjugate.
Figure 99:
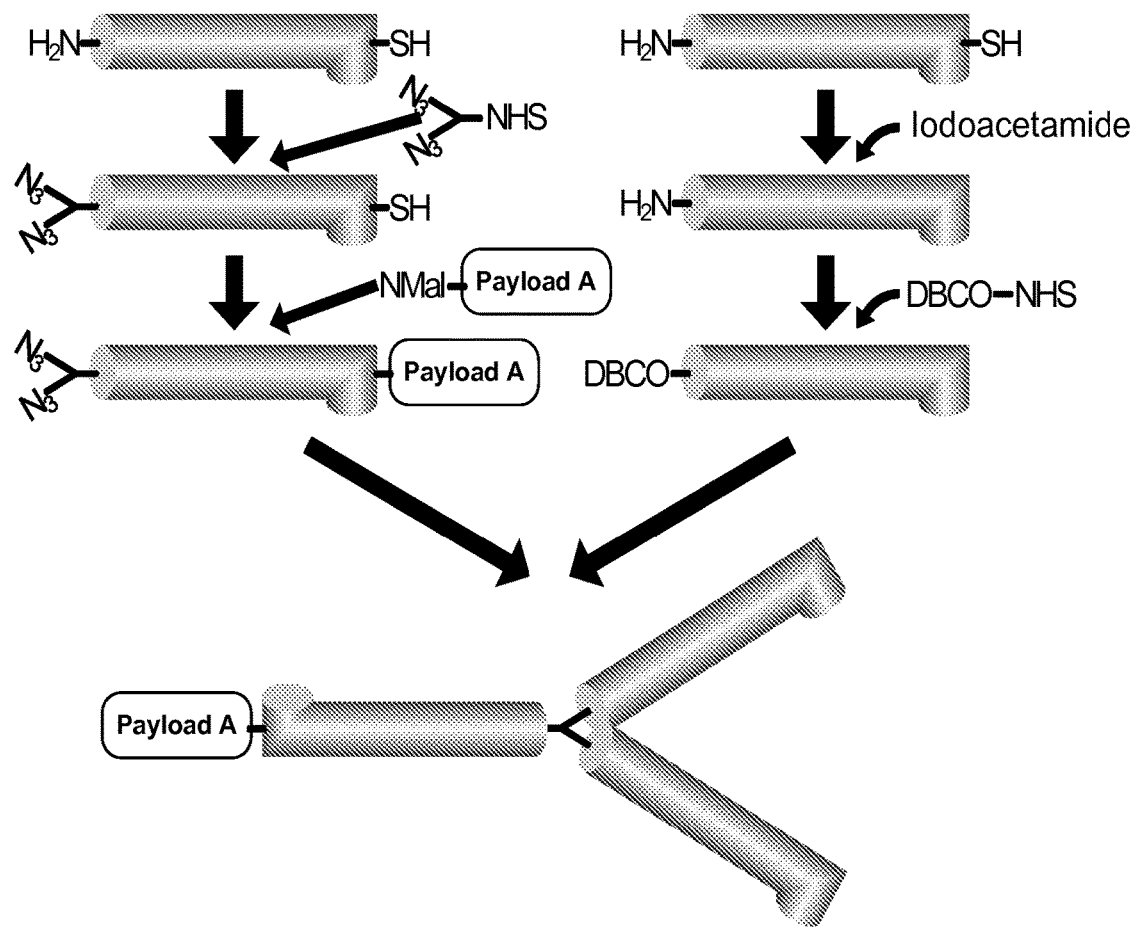
FIG. 99 illustrates a scheme for synthesis of a conjugate between a branched XTEN and a single payload molecule. An intermediate is produced by reacting XTEN with a trifunctional linker comprising two azide functions and an NHS function followed by the addition of payload A to the thiol group via maleimide chemistry (the order of these two steps can be inverted). A second intermediate is produce by reacting XTEN with a cysteine with iodoacetamide to block the free thiol group followed by addition of DBCO to the alpha-amino group via NHS activation (the order of these two steps can be inverted). Subsequently, the two intermediate molecules are conjugated using a click chemistry reaction, resulting in the final XTEN-payload conjugate.
Figure 100:
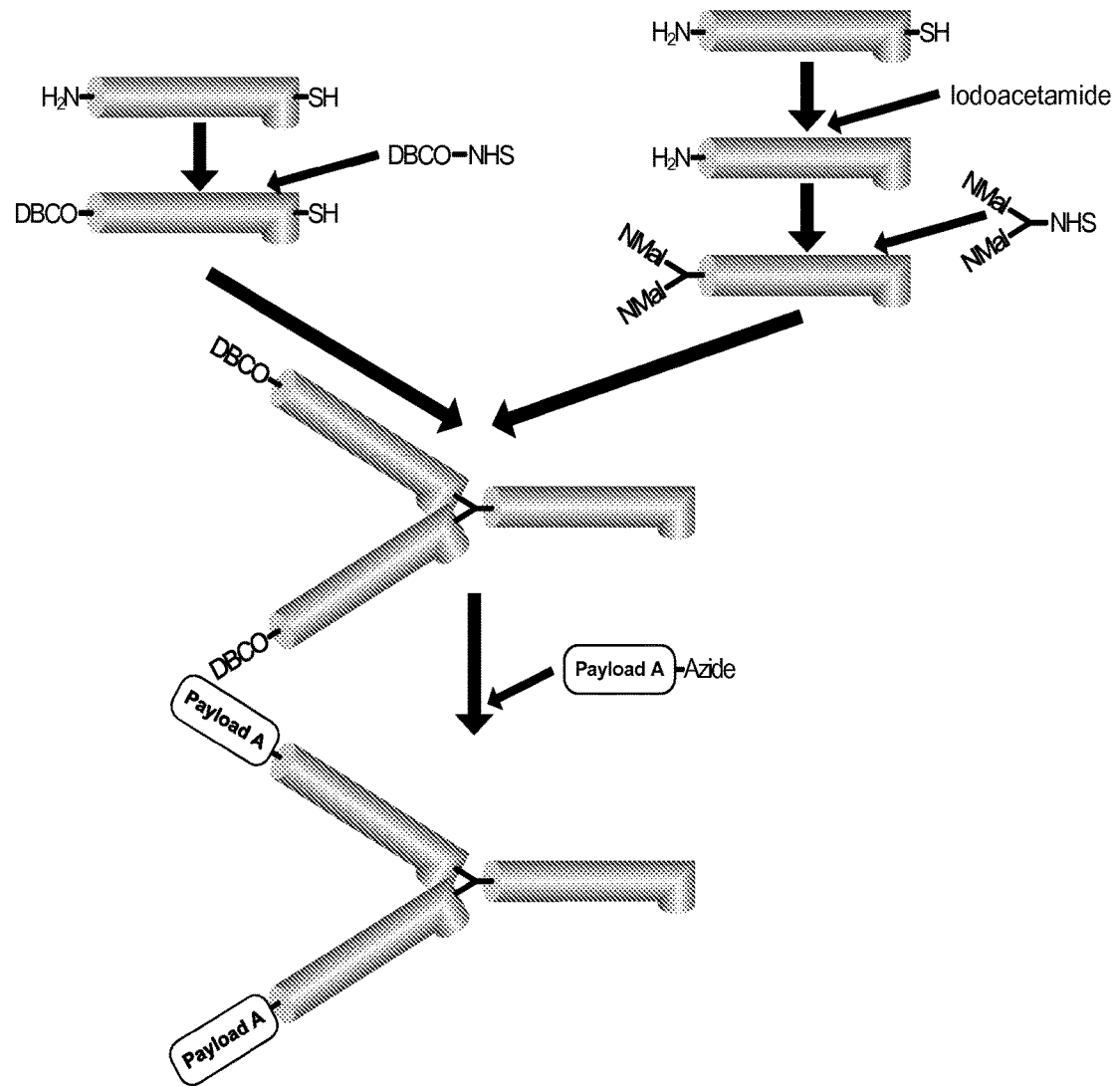
FIG. 100 illustrates a scheme for synthesis of a conjugate having a branched XTEN and two identical payload molecules. An intermediate is produced by adding a DBCO group to the alpha-amino group of an XTEN via NHS chemistry. A second intermediate is produced by blocking the free thiol group of an XTEN with iodoacetamide followed by addition of a trifunctional cross-linker (2 N-maleimide groups and a carboxyl group that is activated by NHS) to the alpha amino-group (the order of these two steps can be inverted). The two intermediates are reacted resulting in the branched conjugate, and then two payload A molecules are added via click chemistry reaction resulting in the final product XTEN-payload conjugate.
Figure 101:
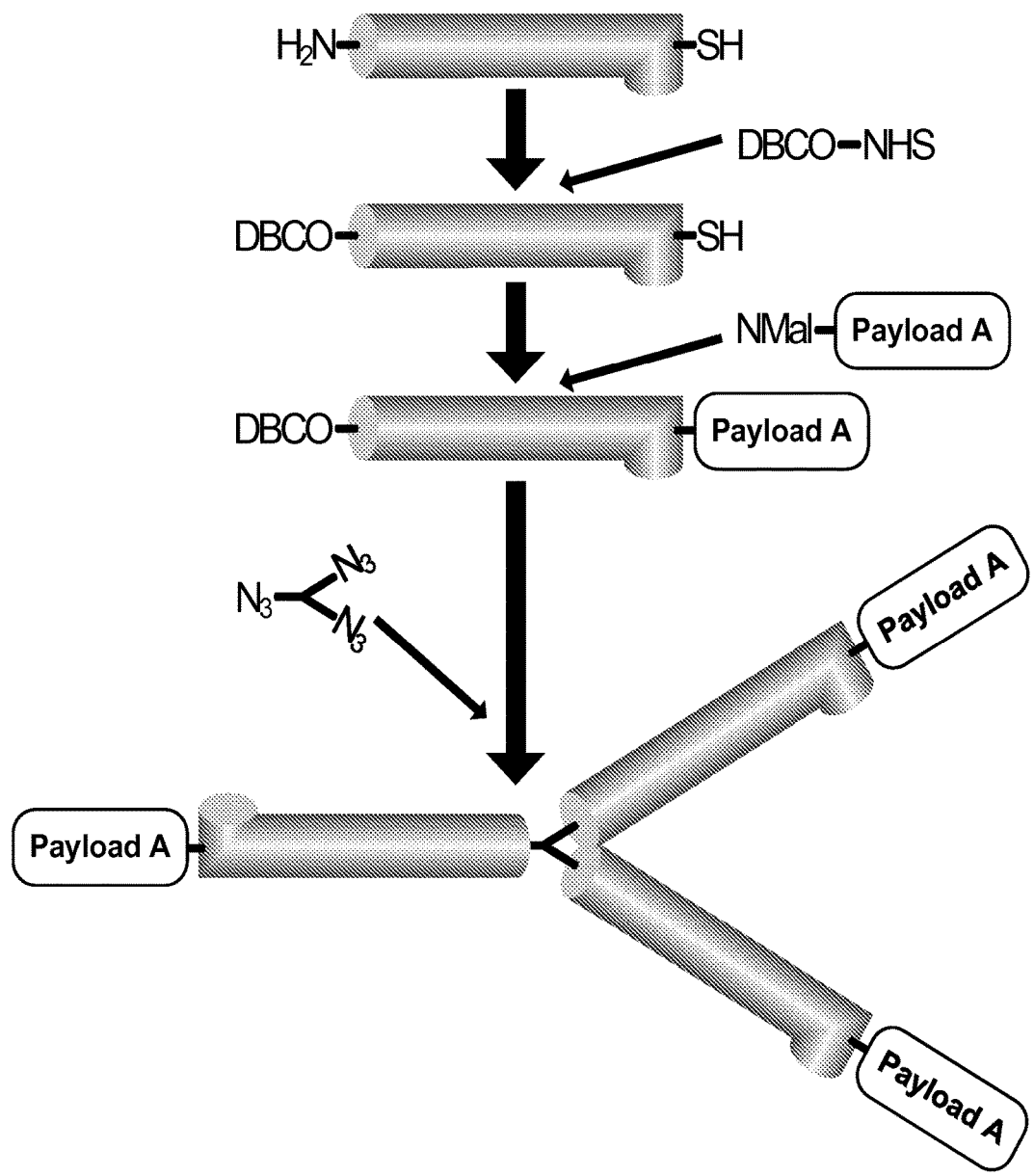
FIG. 101 illustrates a scheme for synthesis of a conjugate having a branched XTEN and three identical payload molecules. An intermediate is produced by adding a DBCO group to the alpha-amino group of an XTEN via NHS chemistry. Another intermediate is produced by conjugating payload A to the thiol group of an XTEN via a N-maleimide functional group. The three molecules are linked together via a trifunctional cross-linker comprising three azide functions, resulting in the final XTEN-payload conjugate.
Figure 102:
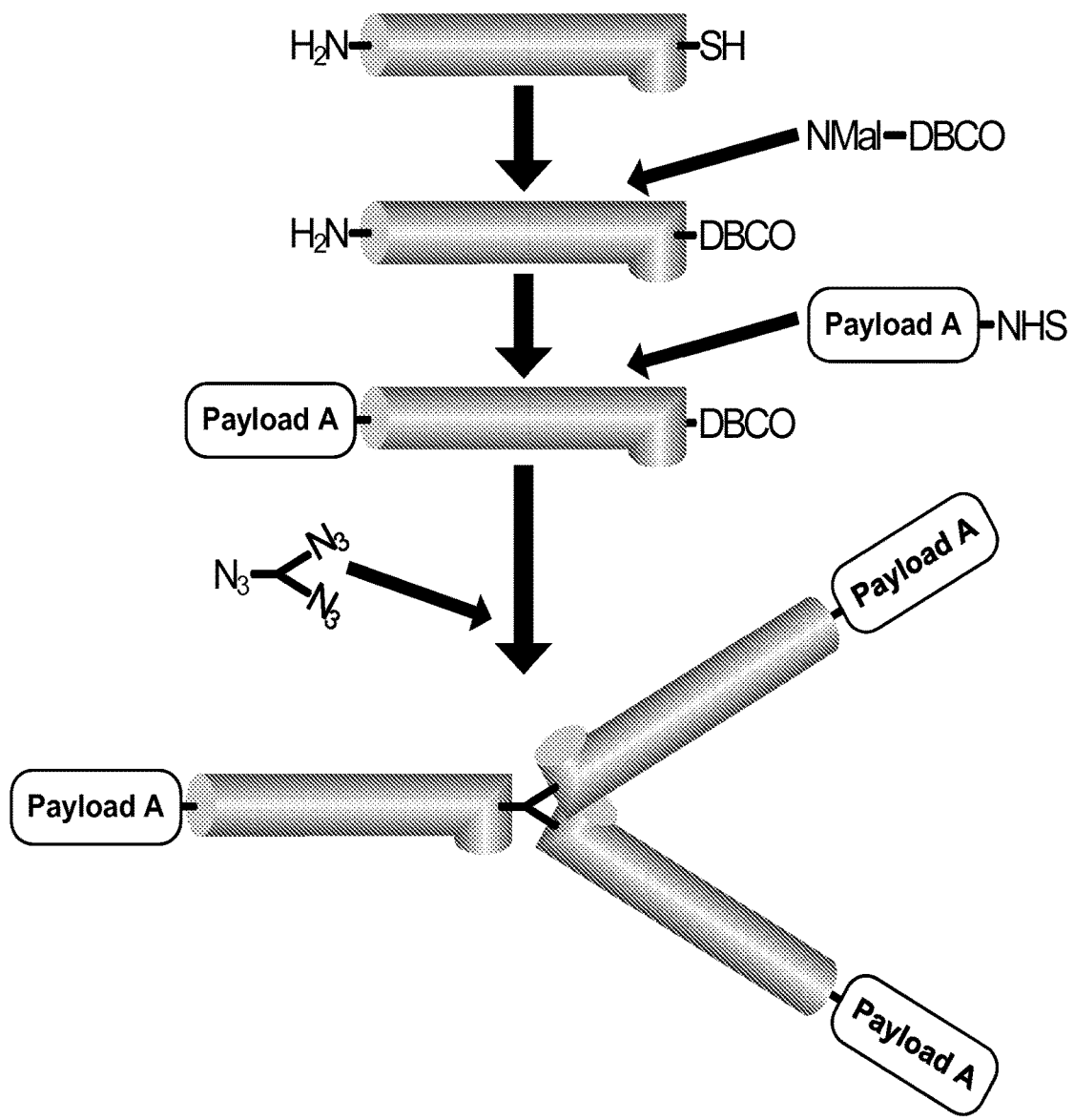
FIG. 102 illustrates a scheme for synthesis of a conjugate having a branched XTEN and three identical payload molecules. An intermediate is produced by adding a DBCO group to the thiol group of an XTEN A via N-maleimide chemistry. In the next step, payload A is conjugated to the alpha amino-group of the XTEN intermediate via NHS chemistry. Three molecules of the resulting XTEN are linked via a trifunctional cross-linker comprising three azide functions, resulting in the final XTEN-payload conjugate.
Figure 103:
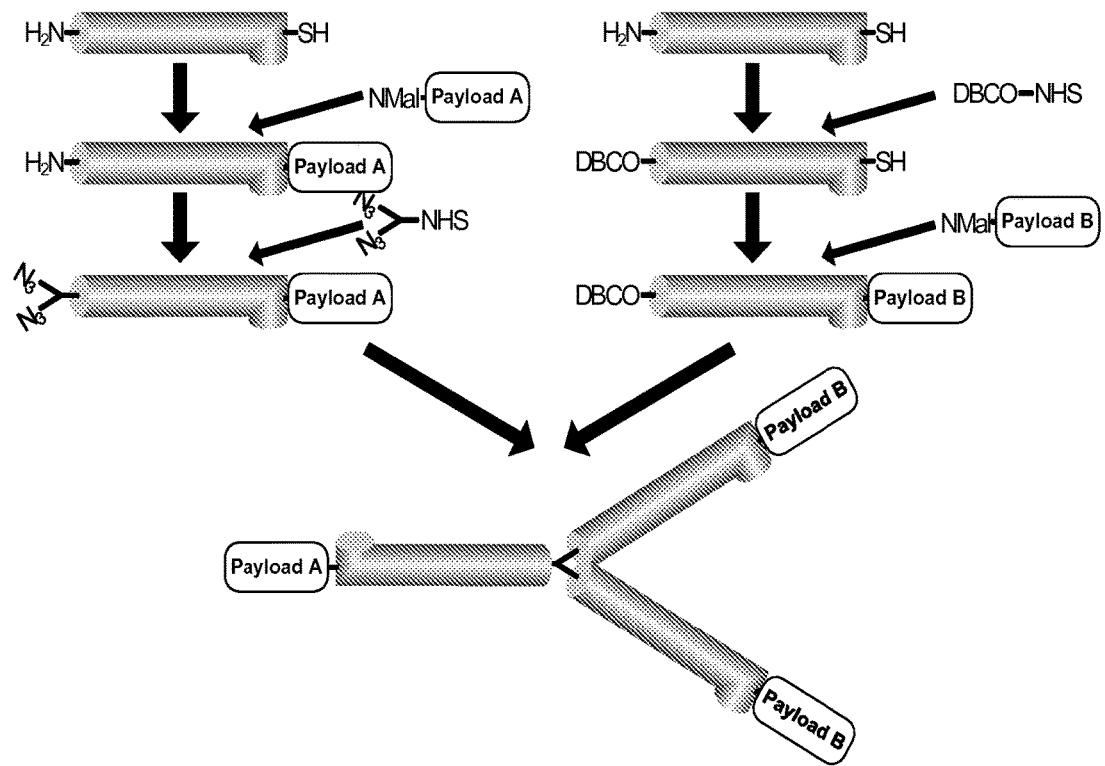
FIG. 103 illustrates a scheme for synthesis of a conjugate having a branched XTEN and two Payload A and one Payload B molecules per conjugate. An intermediate is produced by adding Payload A to the thiol group of an XTEN using an N-maleimide functional group, followed by the addition of a trifunctional cross linker (two azide groups and a carboxyl group that is activated by NHS) to the alpha amino-group (the order of these two steps can be inverted). A second intermediate is produced by adding DBCO to the alpha amino-group of an XTEN via NHS activation followed by the addition of Payload B to the free thiol group of the XTEN using an N-maleimide group (the order of these two steps can be inverted). Two molecules of the second intermediate are reacted with one molecule of the first intermediate to form the final XTEN-payload conjugate.
Figure 104:
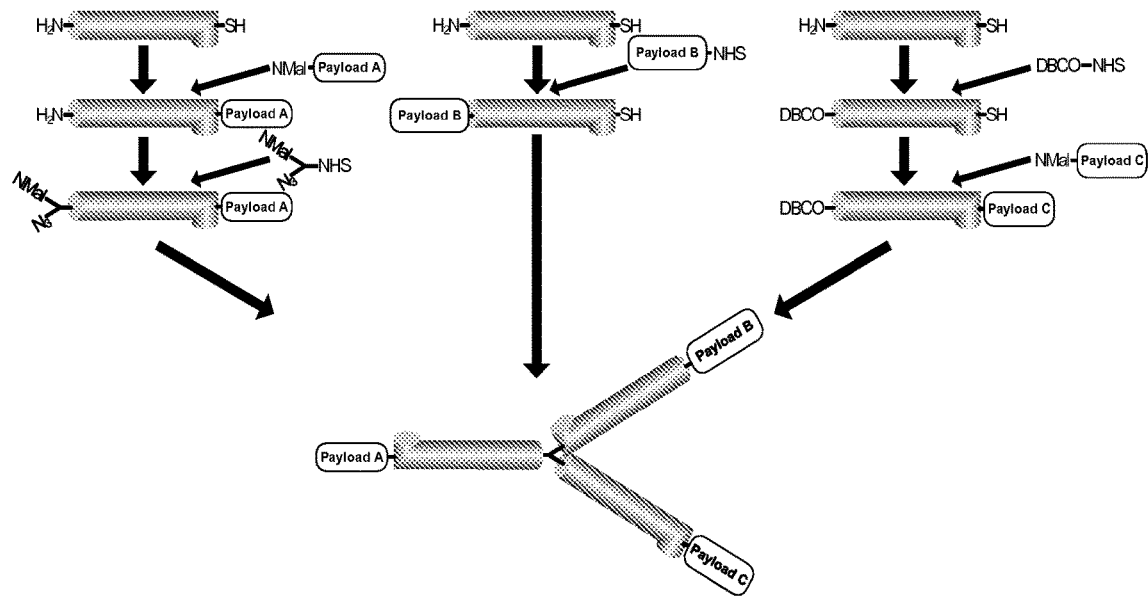
FIG. 104 illustrates a scheme for synthesis of a conjugate having a branched XTEN and three different payloads. An intermediate is produced by adding Payload A to the thiol group on an XTEN using an N-maleimide functional group followed by the addition of a trifunctional cross linker (one azide group, one N-maleimide group and one carboxyl group that is activated by NHS) to the alpha amino-group (the order of these two steps can be inverted). A second intermediate is produced by adding Payload B to the alpha amino-group of XTEN via NHS chemistry. A third intermediate is produced by adding DBCO to the alpha amino-group of an XTEN via NHS activation followed by the addition of payload C to the free thiol group of the XTEN using an N-maleimide group (the order of these two steps can be inverted). The three intermediates are reacted with each other to form the final XTEN-payload conjugate.

Three new N-terminal libraries (LCW1208, LCW1209, and LCW1210) were designed to investigate the effect of further elongation the N-terminal helper sequence (Table 35). LCW1208 and LCW1210 introduced 4 more residues to the helper domain, while LCW1209 introduced 8 more residues. The screening results showed a general trend that LCW1209 had highest expression, followed by LCW1208, and then LCW1210 (FIG. 95), which confirmed the beneficial effect of adding more amino acid in the helper sequence.

TABLE 35

Libraries LCW1208-1210

| Library | N-terminal Helper Sequence (amino acid) | Diversity | Number Screened |
|---|---|---|---|
| LCW1208 | MKKQEQEKEQAEEQ_BXBX_REET (SEQ ID NO: 1071) (B = A/S; X = E/K/Q) | 2304 | 336 |

TABLE 35-continued

Libraries LCW1208-1210

| Library | N-terminal Helper Sequence (amino acid) | Diversity | Number Screened |
|---|---|---|---|
| LCW1209 | MKKQEQEKEQAEEQ_BXBXBXBX_REET (SEQ ID NO: 1072) (B = A/S; X = E/K/Q) | 104976 | 336 |
| LCW1210 | MKKQEQEKEQAEEQ_ZZZZ_REET (SEQ ID NO: 1073) (Z = any amino acid) | 262144 | 336 |

Additional residues in the helper sequences were underlined.

Three new N-terminal libraries (LCW1208, LCW1209, and LCW1210) were designed to investigate the effect of further elongation the N-terminal helper sequence (Table 36). LCW1208 and LCW1210 introduced 4 more residues to the helper domain, while LCW1209 introduced 8 more residues. The screening results showed a general trend that LCW1209 had highest expression, followed by LCW1208, and then LCW1210 (FIG. 95), which confirmed the beneficial effect of adding more amino acids in the helper sequence for improving expression.

The 4 top constructs with the highest expression levels from the three libraries were chosen from the retest and the sequence of their N-terminal helper sequences were analyzed (Table 36). The current highest expressed construct (LCW1209.029) achieved 900 of the expression level of the CBD control by comparing the average florescence after subtracting the negative control.

TABLE 36

Constructs with the highest expression levels from Libraries LCW1208-1210 and controls.

| Sample name | Avg. Fluorescence | Helper sequence* | SEQ ID NO: |
|---|---|---|---|
| LCW 1208.009 | 9070 | MKKQEQEKEQAEEQ*AESE*REET | 1074 |
| LCW 1208.007 | 8870 | MKKQEQEKEQAEEQ*AESE*REET | 1075 |
| LCW 1208.008 | 8800 | MKKQEQEKEQAEEQ*SQSQ*REET | 1076 |
| LCW 1208.010 | 8740 | MKKQEQEKEQAEEQ*SESE*REET | 1077 |
| LCW 1209.029 | 10010 | MKKQEQEKEQAEEQ*AKAESEAE*REET | 1078 |
| LCW 1209.015 | 9440 | MKKQEQEKEQAEEQ*SKSQAEAE*REET | 1079 |
| LCW 1209.023 | 8980 | MKKQEQEKEQAEEQ*AQAQAEDE*REET | 1080 |
| LCW 1209.010 | 8580 | MKKQEQEKEQAEEQ*SKSKAEDE*REET | 1081 |
| LCW 1210.030 | 8650 | MKKQEQEKEQAEEQ*PEVQ*REET | 1082 |
| LCW 1210.032 | 8310 | MKKQEQEKEQAEEQ*VENP*REET | 1083 |
| LCW 1210.025 | 8100 | MKKQEQEKEQAEEQ*ELCE*REET | 1084 |
| LCW 1210.009 | 8030 | MKKQEQEKEQAEEQ*GIDT*REET | 1085 |
| CBD control | 10940 | n/a | |
| Negative control | 1630 | n/a | |

*Additional residues in the helper sequences were underlined.

In summary, the screening results, under these experimental conditions, strongly suggest that an N-terminal helper contributes in achieving high expression levels.

Example 13: Fermentation of XTEN Using PhoA Induction—Evaluation of Expression Yields E. coli BL21 carrying the plasmids encoding Helper_LCW1159.004-RP11-AE288-His8 ("His8" disclosed as SEQ ID NO: 20) (AC767), Helper_LCW1172.033-RP11-AE576-His8 ("His8" disclosed as SEQ ID NO: 20) (AC780), and Helper_LCW1172.033-RP11-AE864-His8 ("His8" disclosed as SEQ ID NO: 20) (AC786) were transformed into the E. coli BL21 strain. Three 10 L fermentations were run for each of the 3 strains. Glycerol stocks were used to inoculate 125 mL of LB broth media containing 10 μg/mL tetracyclin. The starter cultures were then shaken overnight at 37° C. The starter culture was used to inoculate 4 L of fermentation batch media containing ~20 g ammonium sulfate, 10.4 g potassium phosphate dibasic anhydrous, 5 g sodium citrate dihydrate; 4.6 g sodium phosphate monobasic monohydrate; 106 g NZ BL4 soy peptone (Kerry Bioscience #5X00043); 54 g yeast extract (Teknova #Y9020); 3.6 L water; 0.05 mL polypropylene glycol; 5.2 mL trace elements solution (Amunix recipe 144-1); 35 mL 1M magnesium sulfate; and 4 mL Kanamycin (50 mg/mL)—in 10 L glass jacketed vessel with a B. Braun Biostat B controller. The fermentation control settings were: pH=6.9+/−0.1; dO$_2$=10%; dissolved oxygen cascade in stirrer only mode with a range of 125-1180 rpm; air flow of 5 liters per minute of 90% oxygen; initial temperature 37° C.; base control 13% ammonium hydroxide; and no acid control. After 6 hours of culture a 70% glycerol feed was initiated at a rate of 40 g/hr. Upon the cultures reaching an OD600 of 50+/−10 OD the culture temperature was lowered to 26° C., 54 mL of 1M magnesium sulfate was added, and a salt feed consisting of: 10 g/l ammonium sulfate, 26 g/l potassium phosphate dibasic anhydrous, 2 g/l sodium citrate dihydrate; 13 g/l sodium phosphate monobasic monohydrate; 15 g/l potassium phosphate monobasic anhydrous; 0.08% trace elements solution, was started at a rate of 33 g/L and continued for 6 hours. After a total fermentation run time of 64-70 hours the culture was harvested by centrifugation yielding cell pellets between 1.6-2.3 kilograms in wet weight. The pellets were stored frozen at −80° C. until further use. For titer analysis, end of run fermentation whole broth samples were frozen in a 0.2 mL volume, then later thawed, then 0.2 mL of water was added, then to lyse and flocculate host proteins the samples were incubated at 85° C. for 15 minutes, then transferred to 4° C. for 15 minutes, followed centrifugation for 10 minutes at 20,000 g. The resulting flocculated soluble lysates were assayed by C18 reversed phased HPLC, and the A214 absorbance area corresponding of the peaks representing the Helper-RP11-XTEN-His8 ("His8" disclosed as SEQ ID NO: 20) was compared to that of purified reference standard. Next, to determine the dry cell weight (DCW), aliquots of cells were pelleted and the supernatant discarded. The cell pellet was washed once with water, and was then dried in an oven at 80° C. for 3 days. The tubes containing cell pellets were weighed, the weight of the tube was subtracted from the measured weights, and the remaining weight was divided by the initial volume of each sample (0.0002 L) to obtain the DCW. The results of the fermentation growth, titer analysis, and dry cell weight are summarized in Table 37 below. In 96-well plate screening assays, when a library of RP11-XTEN-His8 ("His8" disclosed as SEQ ID NO: 20) constructs without an N-terminal helper, LCW1160 were screened (Example 12, FIG. 86) the expression level of the LCW1160.006, the highest expression construct, was only 50% of the expression of LCW1159.004 or LCW1172.033; constructs with helper sequences. Therefore, it is expected that XTEN constructs with N-terminal helper sequences will result in significantly higher expression titers compared to XTEN constructs not having helper sequences.

2. Capture Step: Toyopearl IMAC Chromatography

IMAC affinity chromatography was used as a capture step for binding the XTEN with an intact C-terminal His-tag. Briefly, the chromatography column BPG140/12 (GE Life Sciences) was packed with 2000 ml Toyopearl IMAC 650 M resin (TOSOH Biosciences). The column was equilibrated with 2 column volumes (CVs) of equilibrium buffer (20 mM sodium phosphate, 500 mM NaCl, pH 8.0). Clarified cell lysate was adjusted to a final NaCl concentration of 500 mM using 5 M NaCl stock solution, and then was loaded onto the IMAC resin. The column was washed with 2 column volumes of equilibrium buffer, and then 2 column volumes of 20 mM sodium phosphate, 500 mM NaCl, 5 mM Imidazole pH 8.0, followed by 2 column volumes of 20 mM sodium

TABLE 37

Measured expression parameters

| XTEN Series | Fermentation # | Final O.D. | Total Run Time (hours) | Dry cell weight per Liter of Ferm (g/L) | Titer by culture volume (g/L) | Average titer (micromoles/L) | Titer/Dry weight ferm (mg of XTEN/g of E. coli) | MW (g/mol) | Titer (micromoles/L) | Average titer (micromoles/L) | Std error of the mean (micromoles/L) |
|---|---|---|---|---|---|---|---|---|---|---|---|
| Helper_ LCW1159.00 4-RP11-AE288-His8 (AC767) | EC846 | 140 | 67.5 | 95 | 0.5 | 0.7 | 5.6 | 26399 | 212 | 27 | 76 |
| | EC888 | 140 | 64 | 85 | 0.8 | | 9.4 | 26399 | 357 | 1 | |
| | EC903 | 136 | 69 | 103 | 0.7 | | 6.4 | 26399 | 243 | | |
| Helper LCW1172.03 3-RP11-AE576-His8 (AC780) | EC850 | 125 | 66 | 107 | 1.1 | 2.0 | 10.0 | 52929 | 189 | 38 | 182 |
| | EC869 | 140 | 70 | 90 | 2.1 | | 22.8 | 52929 | 430 | 8 | |
| | EC883 | 170 | 67 | 102 | 2.9 | | 28.8 | 52929 | 545 | | |
| Helper LCW1172.03 3-RP11-AE864-His8 (AC786) | EC873 | 135 | 68 | 91 | 2.0 | 2.1 | 22.2 | 79284 | 280 | 27 | 41 |
| | EC889 | 145 | 65.5 | 95 | 2.3 | | 24.4 | 79284 | 308 | 2 | |
| | EC913 | 108 | 67 | 108 | 2.0 | | 18.1 | 79284 | 228 | | |

Example 14: Purification of XTEN with RP11 and His8 Tags ("His8" Disclosed as SEQ ID NO: 20)

1. Expression, Lysis and Clarification

The fusion protein MKNPEQAEEQAEEQREET-RP11-SASRSA-XTEN_AE432(C12,C217,C422)-SASRSA-His(8)] ("MKNPEQAEEQAEEQREET," "SASRSA" and "His8" disclosed as SEQ ID NOS 1086, 21 and 20, respectively), with the N-terminal helper sequence from the library member LCW1159.004 described in Example 10, with two affinity tags linked to XTEN at the N- and C-terminus, respectively, was expressed in E. coli using a 4 L fermenter using conditions described herein. After growth, the cells were harvested by centrifugation and frozen at −80° C. until use. The cell pellet was resuspended in lysis buffer (20 mM sodium phosphate, 50 mM NaCl, 2 mM EDTA pH 8.0, 3 ml buffer per gram cell paste). The cells were lysed by passing through an APV homogenizer three times at a pressure of 830-900 bar. Lysis buffer (1 ml buffer per gram cell paste) was used as a chase to retrieve hold up volume from the homogenizer. The homogenized lysate was incubated in a water bath at 85° C. for 20 minutes, followed by quick cooling in ice water bath for 20 minutes. After the heating and cooling treatment, the lysate was centrifuged at 11000 RPM for 90 minutes in a SORVALL centrifuge. After centrifugation, the supernatant was filtered through two CUNO Bio cap 25 (BC0025L90SP08A) filters. The clarified supernatant was stored at 4° C. overnight.

phosphate, 5 mM imidazole pH 8.0 to remove salt. Elution was performed with 2 column volumes of 20 mM sodium phosphate, 100 mM imidazole, pH 8.0. The flow through, wash and elution fractions were analyzed by non-reducing 4-12% Bis-Tris SDS-PAGE/Coomassie staining and the fractions with the desired product were pooled.

3. Polishing/Capture Step: MacroCap SP Chromatography

Cation exchange chromatography was used as a polishing step to ensure the N-terminal integrity of the product. MacroCap SP resin (GE Life Sciences) was selected among several cation exchange media due to its superior capacity and selectivity for the product. 1000 ml of MacroCap SP resin was packed in a BPG100/13 (GE Life Sciences) chromatography column and equilibrated with 20 mM sodium phosphate pH 8.0, 20 mM NaCl. The IMAC pool was loaded onto the column and the resin was washed with 2 column volumes of 20 mM sodium phosphate, 50 mM NaCl, pH 8.0 and 2 column volumes of 20 mM sodium phosphate pH 8.0, 150 mM NaCl. The protein was eluted with 5 column volumes of linear gradient from 150 to 500 mM NaCl in 20 mM sodium phosphate pH 8.0. Fractions were collected and analyzed by 4-12% Bis-Tris SDS-PAGE. Fractions the with desired product were combined for the next step.

4. Trypsin Digestion of Macrocap SP Elution Pool

Trypsin (Sigma, Trypsin from Bovine Pancreas) digestion of the SP elution pool was performed at 1:200 m/m enzyme/protein ratio overnight at 37° C.

5. Polishing Step: Macrocap Q Chromatography

After trypsin digestion, the cleaved tags were separated from the final product using Macrocap Q chromatography. The BPG100/19 column (GE Life Sciences) was packed with 1500 ml column volume of Macrocap Q resin (GE Life Sciences). The trypsin digested Macrocap SP elution pool was incubated for 15 min at 80° C. with 20 mM DTT and 2 mM EDTA to reduce disulfide bonds and to inactivate trypsin. The cooled protein solution was diluted to a conductivity below 5 mS/cm with Milli-Q water and loaded onto the Macrocap Q column equilibrated with 20 mM HEPES, 50 mM NaCl, pH 7.0. The column was washed with 2 column volumes of 20 mM HEPES, 50 mM NaCl, pH 7.0, then 2 column volumes of 20 mM HEPES, 2 mM TCEP, 150 mM NaCl pH7.0. The protein was eluted with a linear gradient from 150 mM NaCl to 500 mM NaCl in 20 mM HEPES, pH 7.0 in 20 column volumes. Fractions were analyzed by SDS-PAGE/silver staining.

6. Concentration and Diafiltration (Final Formulation)

Selected MacroCap Q fractions were combined and concentrated and using 10 KD Pellicon mini (Millipore) at a feed pressure <20 psi and retentate <8 psi, followed by 10× diafiltration with 20 mM HEPES, 50 mM NaCl, pH 7.0 to achieve a final protein concentration of >5 mg/ml.

9. Purity Analysis of Proteins Purified with Different Methods

Figure 87:
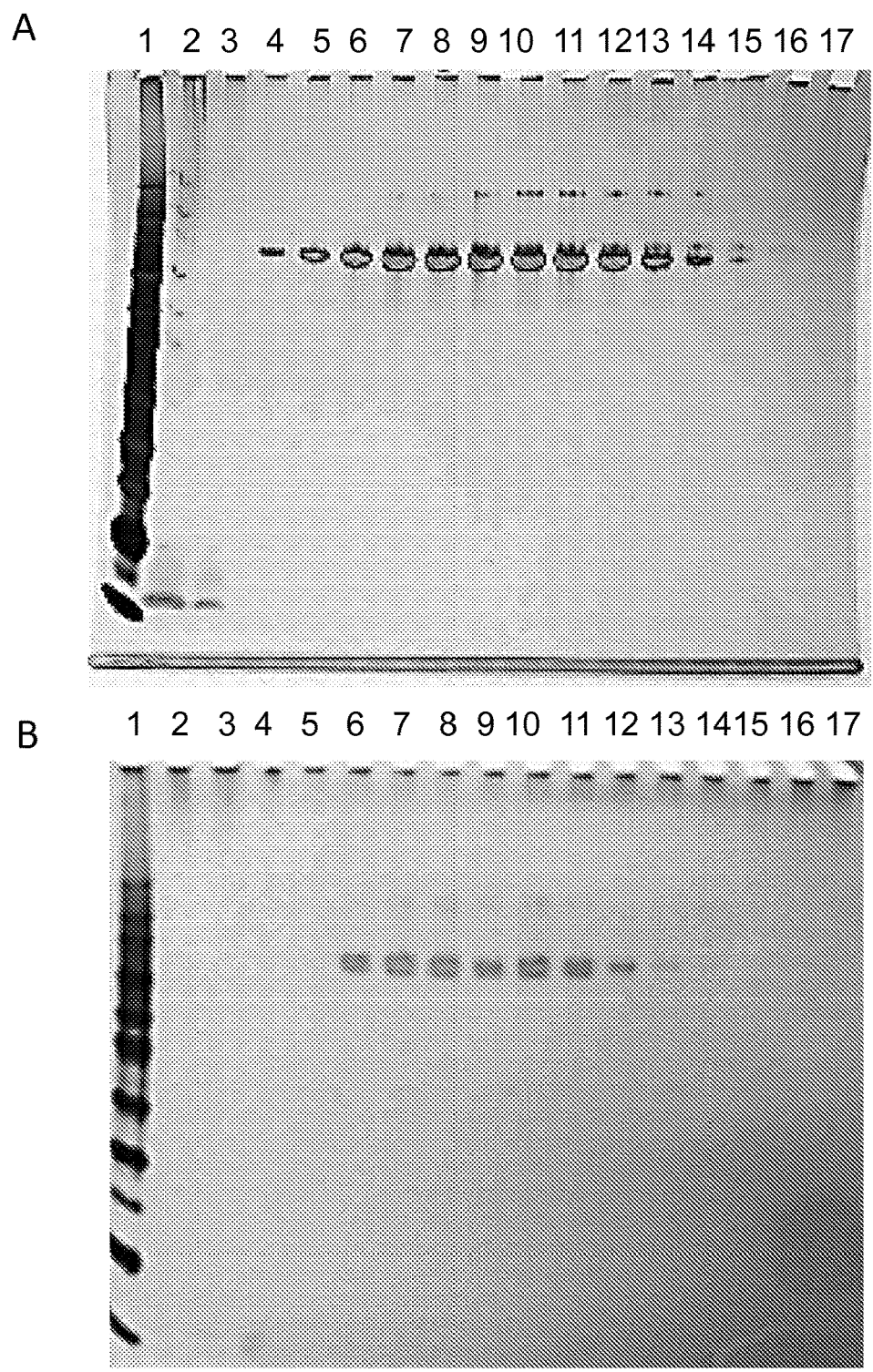
FIG. 87 shows 4-12% SDS-PAGE/silver staining analysis of MacroCap Q fractions as described in Example 14.

One batch (Batch 1) was purified through three purification steps as described above. Another batch (Batch 2) was purified from the same fermented material but the MacroCap SP polishing step was omitted. Truncated species of XTEN were detected by SDS-PAGE/silver staining in MacroCap Q elution fractions for Batch 2 (FIG. 87A), while the MacroCap Q elution fractions for Batch 1 were essentially free from truncations (FIG. 87B). These results support that, under the conditions employed, the MacroCap SP step based on the RP11 tag is essential to ensure N-terminal integrity and overall product quality.

Example 15: Construction of 1×Amino, 9×Thiol-XTEN432

The following sets of primers 5Afor&CI1BbsIrev-TGGC, CI1BsaIfor-TGGC&CI2-AE38BbsIrev, and CI2-AE38BsaIfor&AatIICI3-2P were used to PCR plasmid pCW1164 containing XTEN_AE432 (C422) in order to obtain the PCR products of AE-CI1, CI1-2 and CI2-3, respectively. CI1, 2&3 were designated Cysteine Island1, 2&3, having the same amino acid sequence TAEAAGCG-TAEAA (SEQ ID NO: 189) but with different codon usages. Gel-purification of the PCR products was performed to obtain bands of the right sizes, which were digested with restriction enzymes SbfI/BbsI, BsaI/BbsI and BsaI/AatII, respectively, as the inserts. Digestion of the plasmid pCW1164, which encodes the gene of N-term-RP11-R-XTEN_AE432 (C422)-R-H8 ("H8" disclosed as SEQ ID NO: 20), was performed with SbfI/AatII to remove the fragment of about 290 amino acids within XTEN_AE432 and gel-purification was performed on the remaining large fragment as the vector. Ligation of the vector with the three inserts of PCR products, above, was performed and used to transform BL21 competent cells in order to obtain the construct N-term-RP11-R-XTEN_AE432 (C319, C370, C422)-R-H8 ("H8" disclosed as SEQ ID NO: 20). PCR was performed on this construct with primers CI1BsaIfor-TGGC&AatIICI3-2P to obtain a PCR product of around 360 bp in length. Gel-purification of the band of the right size was performed, followed by digestion with BsaI/AatII as the insert XTEN_AE120-3Cys, which contains three Cysteine Islands.

Simultaneously, the codon-optimized DNA fragment of XTEN_AE313-6Cys, containing six Cysteine Islands, was designed and synthesized (Genscript). The fragment was digested by the flanking restriction enzymes BsaI/BbsI and gel-purified as the insert containing the first six Cysteine Islands of XTEN_AE432. Digestion of the plasmid pCW1161, which encodes the gene of N-term-RP11-R-XTEN_AE432_3Cys-R-H8 ("H8" disclosed as SEQ ID NO: 20), with BsaI/AatII was performed to remove the fragment of XTEN_AE432_3Cys and gel-purification was performed to obtain the large fragment as the vector. Ligation of the vector with the BsaI/BbsI digested insert of XTEN_AE313-6Cys and BsaI/AatII digested insert of XTEN_AE120-3Cys, above, was performed. The ligated product was used to transform BL21 competent cells in order to obtain the construct N-term-RP11-R-XTEN_AE432 (C12, C63, C114, C165, C217, C268, C319, C370, C422)-R-H8 ("H8" disclosed as SEQ ID NO: 20). The construct was designed to produce the precursor N-term-RP11-R-AE432_9Cys-R-H8 ("H8" disclosed as SEQ ID NO: 20) (sequence in Table 38, below), the product of which was used to generate 1×Amino, 9-Thio-XTEN432 after removal of the N-term-RP11 tag and C-term 8×His-tag (SEQ ID NO: 20) by trypsin digestion. The final product contains nine cysteines in the XTEN432 sequence (Seg 177).

TABLE 38

DNA and amino acid sequence for 1×Amino, 9-Thio-XTEN432

| Clone Name | DNA Seguece | Amino Acid Sequence |
|---|---|---|
| N-term-RP11-R-AE432_9Cys-R-H8 ("H8" diclosed as SEQ ID NO: 20) | ATGAAAAACCCAGAGCAAGCAGAAGAAC | MKNPEQAEEQAEE |
| | AAGCTGAAGAACAGCGCGAAGAAACACG | QREETRPRPRPRP |
| | TCCGCGTCCTCGCCCACGTCCACGTCCG | RPRPRPRPRPRPR |
| | CGTCCACGCCCTCGTCCTCGTCCGCGCC | PSASRSAGSPTAE |
| | CTCGTCCGagcgcgtctcgttccgctGG | AAGCGTAEAAPGS |
| | GTCTCCAACGGCAGAGGCAGCAGGTTGT | EPATSGSETPGTS |
| | GGTACAGCAGAAGCAGCTCCGGGTAGCG | ESATPESGPGSEP |
| | AGCCTGCAACCAGCGGTTCTGAGACGCC | ATSGSETPGTAEA |
| | GGGCACTTCCGAATCTGCGACCCCGGAG | AGCGTAEAASTEP |
| | TCCGGTCCAGGTTCAGAGCCGGCGACGA | SEGSAPGTSESAT |
| | GCGGTTCGGAAACGCCGGGTACTGCTGA | PESGPGSPAGSPT |
| | AGCGGCTGGTTGTGGTACTGCTGAAGCT | STEEGSPATAEAA |
| | GCATCGACCGAACCAAGCGAAGGTTCGG | GCGTAEAASPTST |
| | CACCGGGTACTAGCGAGAGCGCAACCCC | EEGTSESATPESG |
| | TGAAAGCGGTCCGGGCAGCCCGGCAGGT | PGTSTEPSEGSAP |
| | TCTCCAACCAGCACCGAAGAAGGTTCCC | GTSESATTAEAAG |
| | CTGCTACTGCCGAAGCTGCAGGCTGCGG | CGTAEAASETPGT |
| | TACTGCGGAGGCGGCGTCCCCAACTTCT | SESATPESGPGSE |
| | ACTGAGGAAGGTACTTCTGAGTCCGCTA | PATSGSETPGTSE |
| | CCCCAGAAAGCGGTCCTGGTACCTCCAC | SATPESGTAEAAG |
| | TGAACCGTCTGAAGGCTCTGCACCAGGC | CGTAEAAGSPAGS |
| | ACTTCTGAGTCTGCTACTACCGCCGAAG | PTSTEEGTSESAT |
| | CCGCTGGTTGTGGTACCGCAGAAGCTGC | PESGPGSEPATSG |
| | ATCTGAGACTCCAGGCACTTCTGAGTCC | SETPGTTAEAAGC |
| | GCAACGCCTGAATCCGGTCCTGGTTCTG | GTAEAAAGSPTST |
| | AACCAGCTACTTCCGGCAGCGAAACCCC | EEGSPAGSPTSTE |
| | AGGTACCTCTGAGTCTGCGACTCCAGAG | EGTSTEPSEGSAP |
| | TCTGGTACCGCGGAAGCGGCTGGTTGTG | GTSESTAEAAGCG |
| | GTACTGCAGAGGCAGCTGGTTCTCCGGC | TAEAATPESGPGT |
| | TGGTAGCCCGACCAGCACGGAGGAGGGT | SESATPESGPGSE |
| | ACGTCTGAATCTGCAACGCCGGAATCGG | PATSGSETPGSEP |
| | GCCCAGGTTCGGAGCCTGCAACGTCTGG | ATSGTAEAAGCGT |
| | CAGCGAAACCCCGGGTACCACGGCGGAA | AEAATEEGTSTEP |
| | GCGGCAGGTTGTGGCACCGCGGAGGCAG | SEGSAPGTSTEPS |
| | CAGCTGGTTCTCCAACCTCTACCGAGGA | EGSAPGSEPATSG |
| | GGGTTCACCGGCAGGTAGCCCGACTAGC | SETPTAEAAGCGT |
| | ACTGAAGAAGGTACTAGCACGGAGCCGA | AEAASASRSAHHH |
| | GCGAGGGTAGTGCTCCGGGTACGAGCGA | HHHHH |

TABLE 38-continued

DNA and amino acid sequence for 1xAmino, 9-Thio-XTEN432

| Clone Name | DNA Sequece | Amino Acid Sequence |
|---|---|---|
| | GAGCACGGCAGAAGCCGCTGGCtgcGGT ACTGCTGAAGCGGCAACCCCTGAGAGCG GCCCAGGTACTTCTGAGAGCGCCACTCC TGAATCCGGCCCTGGTAGCGAGCCGGCA ACCTCCGGCTCAGAAACTCCTGGTTCGG AACCAGCGACCAGCGGTACCGCTGAAGC CGCAGGTtgtGGCACTGCGGAAGCTGCA ACCGAAGAGGGTACCAGCACGGAACCGA GCGAGGGTTCTGCCCCGGGTACTTCCAC CGAACCATCGGAGGGCTCTGCACCTGGT AGCGAACCTGCGACGTCTGGTTCTGAAA CGCCGACTGCAGAAGCGGCTGGTtgtGG CACCGCCGAAGCAGCTagcgcctctcgc tccgcaCATCACCATCACCACCATCATC ACTAA (SEQ ID NO: 1087) | (SEQ ID NO: 1088) |

Example 16: Construction of 1×Amino, 9×Thiol-XTEN864

The primers PhoAfor&RP11-SASRSABsaIrevAGGT were used to PCR the plasmid containing N-term-RP11 tag to obtain the PCR product of N-term-RP11-R. Gel-purification of the band of the right size was performed and was digested with NdeI/BsaI as the first insert. Another PCR was performed with primers AE432BsaIforAGGT&AE432_001BbsIrev-AACG on the plasmid containing XTEN_AE864_003 in order to obtain the PCR product of XTEN_AE432. Gel purification was performed on the band of the right size, which was digested with BsaI/BbsI as the second insert. Digestion of the construct N-term-RP11-R-AE432_9Cys-R-H8 ("H8" disclosed as SEQ ID NO: 20) from Example 10 was performed with NdeI/BsaI to remove the N-term-RP11-R fragment and gel purification was performed to obtain the large fragment as the vector. Ligation of the vector with the first and second inserts, above, was performed and the product was used to transform BL21 competent cells in order to obtain the construct N-term-RP11-R-XTEN_AE864 (C444, C495, C546, C597, C649, C700, C751, C802, C854)-R-H8 ("H8" disclosed as SEQ ID NO: 20). The resulting construct was designed to produce the precursor N-term-RP11-R-AE864_9Cys-R-H8 ("H8" disclosed as SEQ ID NO: 20) (sequence in Table 39, below) the product of which would generate 1×Amino, 9-Thio-XTEN864 after removal of the N-term-RP11 tag and C-term 8×His-tag (SEQ ID NO: 20) by trypsin digestion. The resulting product contains an N-terminal amino group and nine cysteines in the XTEN864 sequence for conjugation (Seg 175).

TABLE 39

DNA and amino acid sequence for 1xAmino, 9-Thio-XTEN864

| Clone Name | DNA Sequence | Amino Acid Sequence |
|---|---|---|
| N-term-RP11-R-AE864_9Cys-R-H8 ("H8" diclosed as SEQ ID NO: 20) | ATGAAAAACCCAGAGCAAGCAGAAGAAC AAGCTGAAGAACAGCGCGAAGAAACACG TCCGCGTCCTCGCCCACGTCCACGTCCG CGTCCACGCCCTCGTCCTCGTCCGCGCC CTCGTCCGagcgcgtctcgttccgctGG GTCTCCAGGTAGCCCAGCTGGTAGCCCA ACCTCTACCGAAGAAGGTACCTCTGAAT CCGCTACTCCAGAATCCGGTCCTGGTAC TAGCACTGAGCCAAGCGAAGGTTCTGCT CCAGGCTCCCCGGCAGGTAGCCCTACCT CTACCGAAGAGGGCACTAGCACCGAACC ATCTGAGGGTTCCGCTCCTGGCCACCTCC ACTGAACCGTCCGAAGGCAGTGCTCCGG GTACTTCCGAAAGCGCAACTCCGGAATC CGGCCCTGGTTCTGAGCCTGCTACTTCC GGCTCTGAAACTCCAGGTAGCGAGCCAG CGACTTCTGGTTCTGAAACTCCAGGTTC ACCGGCGGGTAGCCCGACGAGCACGGAG GAAGGTACCTCTGAGTCGGCCACTCCTG AGTCCGGTCCGGCACGAGCACCGAGCC GAGCGAGGGTTCAGCCCCGGGTACCAGC ACGAGCCGTCCGAGGGTAGCGCACCGG GTTCTCCGGCGGGCTCCCCTACGTCTAC GGAAGAGGGTACGTCCACTGAACCTAGC GAGGGCAGCGCGCCAGGCACCAGCACTG AACCGAGCGAAGGCAGCGCACCTGGCAC TAGCGAGTCTGCGACTCCGGAGAGCGGT CCGGGTACGAGCACGGAACCAAGCGAAG GCAGCGCCCCAGGTACCTCTGAATCTGC TACCCCAGAATCTGGCCCGGGTTCCGAG CCAGCTACCTCTGGTTCTGAAACCCCAG GTACTTCCACTGAACCAAGCGAAGGTAG CGCTCCTGGCACTTCTACTGAACCATCC GAAGGTTCCGCTCCTGGTACGTCTGAAA GCGCTACCCCTGAAAGCGGCCCAGGCAC CTCTGAAAGCGCTACTCCTGAGAGCGGT CCAGGCTCTCCAGCAGGTTCTCAACCT CCACTGAAGAAGGCACCTCTGAGTCTGC TACCCCTGAATCTGGTCCTGGCTCCGAA CCTGCTACCTCTGGTTCCGAAACTCCAG GTACCTCGGAATCTGCGACTCCGGAATC TGGCCCGGGCACGAGCACGGAGCCGTCT GAGGGTAGCGCACCAGGTACCAGCACTG AGCCTTCTGAGGGCTCTGCACCGGGTAC CTCCACGGAACCTTCGGAAGGTTCTGCG CCGGGTACCTCCACTGAGCCATCCGAGG GTTCAGCACCAGGTACTAGCACGGAACC GTCCGAGGGCTCTGCACCAGGTACGAGC ACCGAACCGTCGGAGGGTAGCGCTCCAG GTAGCCCAGCGGGCTCTCCGACAAGCAC CGAAGAAGGCACCAGCACCGAGCCGTCC GAAGGTTCCGCACCAACGGCAGAGGCAG CAGGTTGTGGTACAGCAGAAGCAGCTCC GGGTAGCGAGCCTGCAACCAGCGGTTCT GAGACGCCGGGCACTTCCGAATCTGCGA CCCCGGAGTCCGGTCCAGGTTCAGAGCC GGCGACGAGCGGTTCGGAAACGCCGGGT ACTGCTGAAGCGGCTGGTTGTGGTACTG CTGAAGCTGCATCGACCGAACCAAGCGA AGGTTCGGCACCGGGTACTAGCGAGAGC GCAACCCCTGAAAGCGGTCCGGGCAGCC CGGCAGGTTCTCCAACCAGCACCGAAGA AGGTTCCCCTGCTACTGCCGAAGCTGCA GGCTGCGGTACTGCGGAGCGGCGTCCC CAACTTCTACTGAGGAAGGTACTTCTGA GTCCGCTACCCCAGAAAGCGGTCCTGGT ACCTCCACTGAACCGTCTGAAGGCTCTG CACCAGGCACTTCTGAGTCTGCTACTAC CGCCGAAGCCGCTGGTTGTGGTACCGCA GAAGCTGCATCTGAGACTCCAGGCACTT CTGAGTCCGAACGCCTGAATCCGGTCC TGGTTCTGAACCAGCTACTTCCGGCAGC GAAACCCCAGGTACCTCTGAGTCTGCGA CTCCAGAGTCTGGTACCGGGAAGCGC TGGTTGTGGTACTGCAGAGGCAGCTGGT TCTCCGGCTGGTAGCCCGACCAGCACGG AGGAGGGTACGTCTGAATCTGCAACGCC GGAATCGGGCCCAGGTTCGGAGCCTGCA ACGTCTGGCAGCGAAACCCCGGGTACCA | MKNPEQAEEQAEE QREETRPRPRPRP RPRPRPRPRPRPR PSASRSAGSPGSP AGSPTSTEEGTSE SATPESGPGTSTE PSEGSAPGSPAGS PTSTEEGTSTEPS EGSAPGTSTEPSE GSAPGTSESATPE SGPGSEPATSGSE TPGSEPATSGSET PGSPAGSPTSTEE GTSESATPESGPG TSTEPSEGSAPGT STEPSEGSAPGSP AGSPTSTEEGTST EPSEGSAPGTSTE PSEGSAPGTSESA TPESGPGTSTEPS EGSAPGTSESATP ESGPGSEPATSGS ETPGTSTEPSEGS APGTSTEPSEGSA PGTSESATPESGP GTSESATPESGPG SPAGSPTSTEEGT SESATPESGPGSA SESATPESGPGSA PATSGSETPGTSE SATPESGPGTSTE PSEGSAPGTSTEP SEGSAPGTSTEPS EGSAPGTSTEPSE GSAPGTSTEPSEG SAPGTSTEPSEGS APGSPAGSPTSTE EGTSTEPSEGSAP TAEAAGCGTAEAA PGSEPATSGSETP GTSESATPESGPG SEPATSGSETPGT AEAAGCGTAEAAS TEPSEGSAPGTSE SATPESGPGSPAG SPTSTEEGSPATA EAAGCGTAEAASP TSTEEGTSESATP ESGPGTSTEPSEG SAPGTSESATPEA AAGCGTAEAASET PGTSESATPESGP GSEPATSGSETPG TSESATPESGSP AAGCGTAEAAGSP AGSPTSTEEGTSE SATPESGPGSEPA TSGSETPGTSTAEA AGCGTAEAAAGSP TSTEEGSPAGSPT STEEGTSTEPSEG SAPGTSESTAEAA GCGTAEAATPESG PGTSESATPESGP GSEPATSGSETPG SEPATSGTAEAAG CGTAEAATEEGTS TEPSEGSAPGTST EPSEGSAPGSEPA TSGSETPTAEAAG CGTAEAASASRSA HHHHHHHH (SEQ ID NO: 1090) |

TABLE 39-continued

DNA and amino acid sequence
for 1xAmino, 9-Thio-XTEN864

| Clone Name | DNA Sequence | Amino Acid Sequence |
|---|---|---|
| | CGGCGGAAGCGGCAGGTTGTGGCACCGC GGAGGCAGCAGCTGGTTCTCCAACCTCT ACCGAGGAGGGTTCACCGGCAGGTAGCC CGACTAGCACTGAAGAAGGTACTAGCAC GGAGCCGAGCGAGGGTAGTGCTCCGGGT ACGAGCGAGAGCACGGCAGAAGCCGCTG GCtgcGGTACTGCTGAAGCGGCAACCCC TGAGAGCGGCCCAGGTACTTCTGAGAGC GCCACTCCTGAATCCGGCCCTGGTAGCG AGCCGGCAACCTCCGGCTCAGAAACTCC TGGTTCGGAACCAGCGACCAGCGGTACC GCTGAAGCCGCAGGTtgtGGCACTGCGG AAGCTGCAACCGAAGAGGGTACCAGCAC GGAACCGAGCGAGGGTTCTGCCCCGGGT ACTTCCACCGAACCATCGGAGGGCTCTG CACCTGGTAGCGAACCTGCGACGTCTGG TTCTGAAACGCCGACTGCAGAAGCGGCT GGTtgtGGCACCGCCGAAGCAGCTagcg cctctcgctccgcaCATCACCATCACCA CCATCATCACTAA (SEQ ID NO: 1089) | |

Example 17: Fermentation of XTEN for Conjugation

Figure 45:
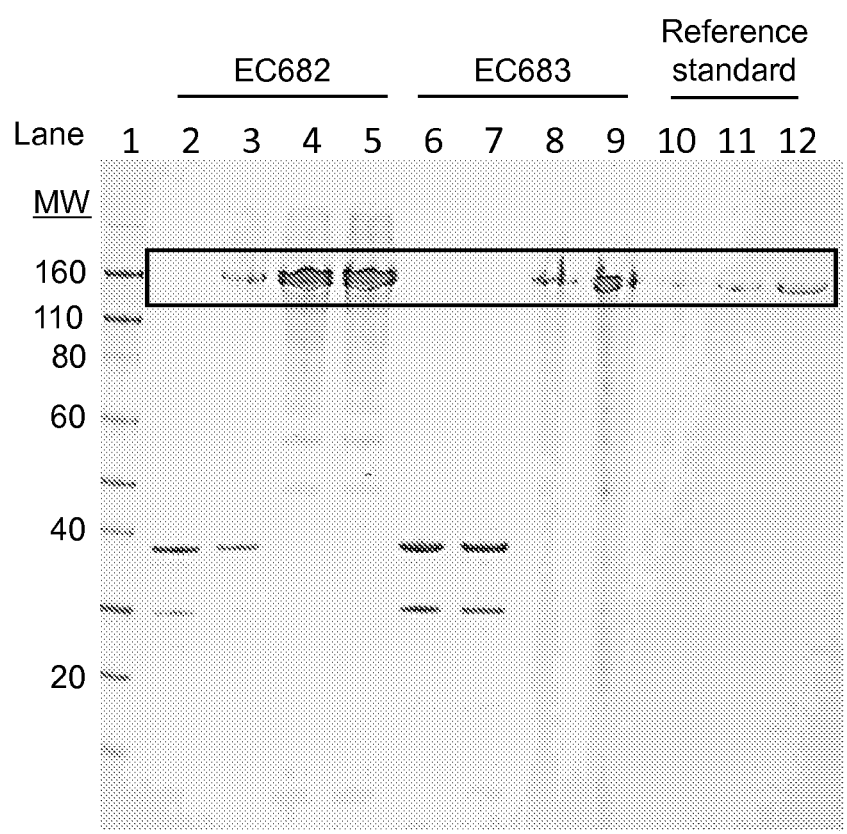
FIG. 45 shows an SDS-PAGE gel of the CBD-R—C-XTEN_AE864-RH8 ("H8" disclosed as SEQ ID NO: 20) (EC682) and CBD-R-XTEN_AE864-RH8 ("H8" disclosed as SEQ ID NO: 20) (EC683) constructs expressed in E. coli fermentations as described in Example 17. Gel lane samples with MW markers and expressed proteins from constructs are: 1) MW marker; E. coli fermentation #EC682 clarified soluble lysates time points after inoculation 2) 16 hours, 3) 24 hours, 4) 40 hours, 5) 45 hours; E. coli fermentation #EC683 clarified soluble lysates at time points after inoculation 6) 16 hours, 7) 24 hours, 8) 40 hours, 9) 45 hours; Purified CBD-R-XTEN_AE864-RH8 ("H8" disclosed as SEQ ID NO: 20) reference standard 10) 1 microgram, 11) 2 micrograms, and 12) 4 micrograms. For the E. coli fermentation clarified soluble lysates each lane represents 3 microliters of the fermenter culture. Full-length protein spots appear within the outline box. Bands of lower molecular weight are host-cell proteins.

Starter cultures were prepared by inoculating glycerol stocks of *E. coli* carrying the plasmid containing the appropriate XTEN for conjugation protein sequences into 125 mL of LB Broth media containing 50 µg/mL kanamycin. The cultures were then shaken overnight at 37° C. The starter culture was used to inoculate 2 L of fermentation batch media containing ~12.5 g ammonium sulfate, 15 g potassium phosphate dibasic anhydrous, 2.5 g sodium citrate dihydrate; 8.5 g sodium phosphate monobasic monohydrate; 50 g NZ BL4 soy peptone (Kerry Bioscience #5X00043); 25 g yeast extract (Teknova #Y9020); 1.8 L water, 0.5 mL polypropylene glycol; 2.5 mL trace elements solution (Amunix recipe 144-1); 17.5 mL 1M magnesium sulfate; and 2 mL Kanamycin (50 mg/mL)—in 5 L glass jacketed vessel with a B. Braun Biostat B controller. The fermentation control settings were: pH=6.9+/−0.1; dO2=10%; dissolved oxygen cascade in stirrer only mode with a range of 125-1180 rpm; air flow of 5 liters per minute of 90% oxygen; initial temperature 37° C.; base control 13% ammonium hydroxide; and no acid control. After 6 hours of culture a 50% glucose feed was initiated at a rate of 30 g/hr. After 20 hours of culture, 25 mL of 1M magnesium sulfate and 3 mL of 1M IPTG were added. After a total fermentation run time of 45 hours the culture was harvested by centrifugation yielding cell pellets between 0.45-1.1 kilograms in wet weight for all constructs. The pellets were stored frozen at −80° C. until further use. Culture samples at multiple time points in the fermentation were taken, the cells were lysed, then cell debris was flocculated with heat and rapid cooling, clarified soluble lysates were prepared by centrifugation and analyzed by a regular non-reducing SDS-PAGE using NuPAGE 4-12% Bis-Tris gel from Invitrogen according to manufacturer's specifications with Coomassie staining. An example of the accumulation of XTEN fusion protein as a function of fermentation run time is shown in FIG. 45. The results showed that the XTEN fusion protein constructs were expressed at fermentation scale with titers>1 g/L, with an apparent MW of about 160 kDa (note: the actual molecular weight are 100 kDa. The observed migration in SDS-PAGE was comparable to that observed for other XTEN-containing fusion proteins).

Example 18: Purification of 1×Thiol-XTEN (Cysteine-Engineered XTEN) Reagent with CBD and His8 Tags (SEQ ID NO: 20)

The example describes the purification of a cysteine-engineered XTEN comprising a single cysteine residue.

Materials and Methods:

1. Clarification 20 gm of cell paste from the fermentation was resuspended in 100 ml of 20 mM sodium phosphate, pH 8.0 (Lysis Buffer). Cell lysate was homogenized between 800-900 bars three times in a homogenizer. 50 ml of lysis buffer was used as a chase to retrieve hold-up volume from the homogenizer. The homogenized lysate was incubated in a water bath at 85° C. for 20 minutes, followed by quick cooling in an ice water bath for 20 minutes. After the heating & cooling treatment, the lysate was centrifuged at 11000 RPM for 90 minutes in SORVALL centrifuge. After centrifugation, the supernatant was filtered through two CUNO Bio cap 25 (BC0025L90SP08A) filters. Filters were chased with 40 ml of lysis buffer. The final volume of clarified material was 230 ml. The clarified supernatant was stored at 4° C. overnight.

2. Capture Step: Hydrophobic Interaction Chromatography

Figure 46:
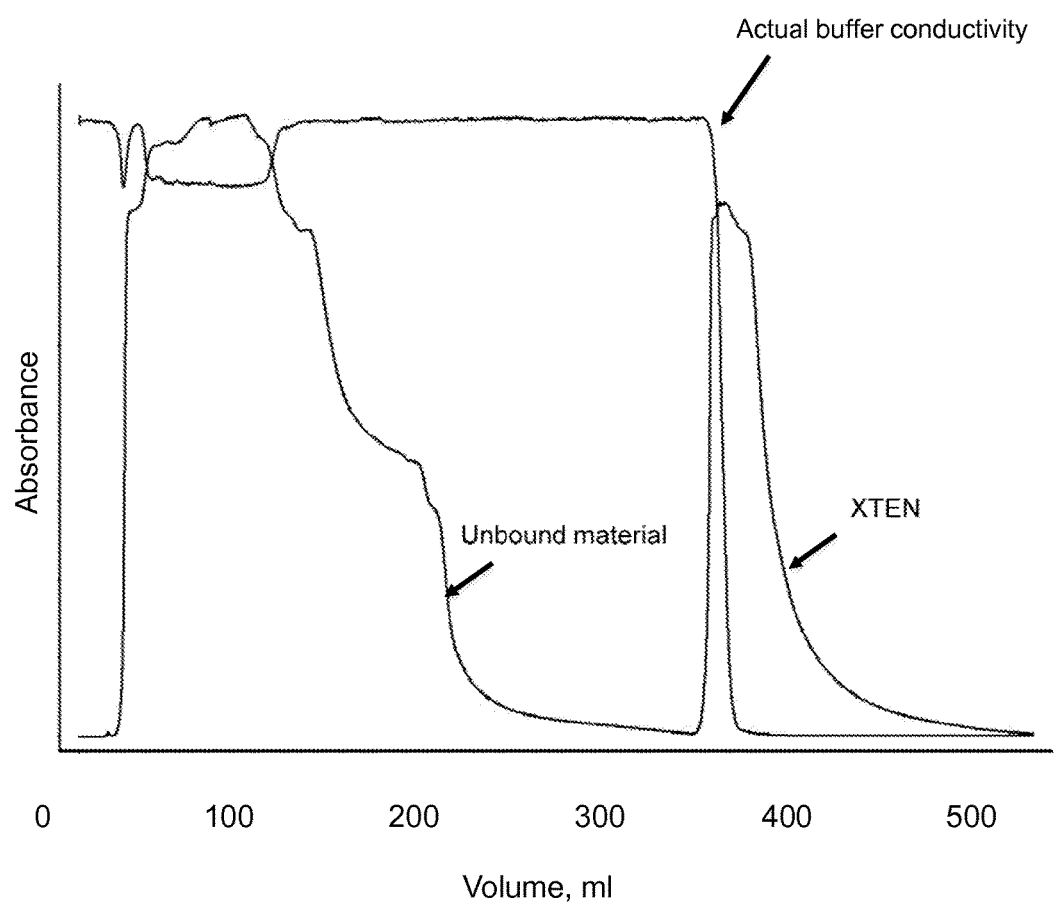
FIG. 46 shows the trace output of Toyopearl Phenyl 650 M Hydrophobic Interaction Chromatography, as described in Example 18.

Hydrophobic interaction chromatography was used as a first step using hydrophobic CBD tag of XTEN to ensure the capture of N-terminal intact protein. Toyopearl Phenyl 650M (Part #0014783, TOSOH Bioscience) was used to pack XK16 to 15 cm bed height (30 ml column volume). The chromatography was performed using AKTA FPLC (GE Biosciences). Toyopearl Phenyl resin was equilibrated with 2 column volume of 20 mM Sodium Phosphate, 1M Sodium Sulfate, pH 8.0 prior to loading. HIC load was prepared by adding Sodium Sulfate to 1 M concentration to above clarified lysate (final volume~250 ml). The sample was loaded on HIC resin (~4 mg/ml resin load) at 2 ml/min. Load was completed by chasing with ~9 column volume of equilibrium buffer (20 mM Sodium Phosphate, 1M Sodium Sulfate, pH 8.0) till UV215 was stable. Protein was step eluted with 100% B (20 mM Sodium Phosphate, pH 8.0). A total of 7 column volumes of elution buffer was applied to confirm complete elution (FIG. 46).

Figure 47:
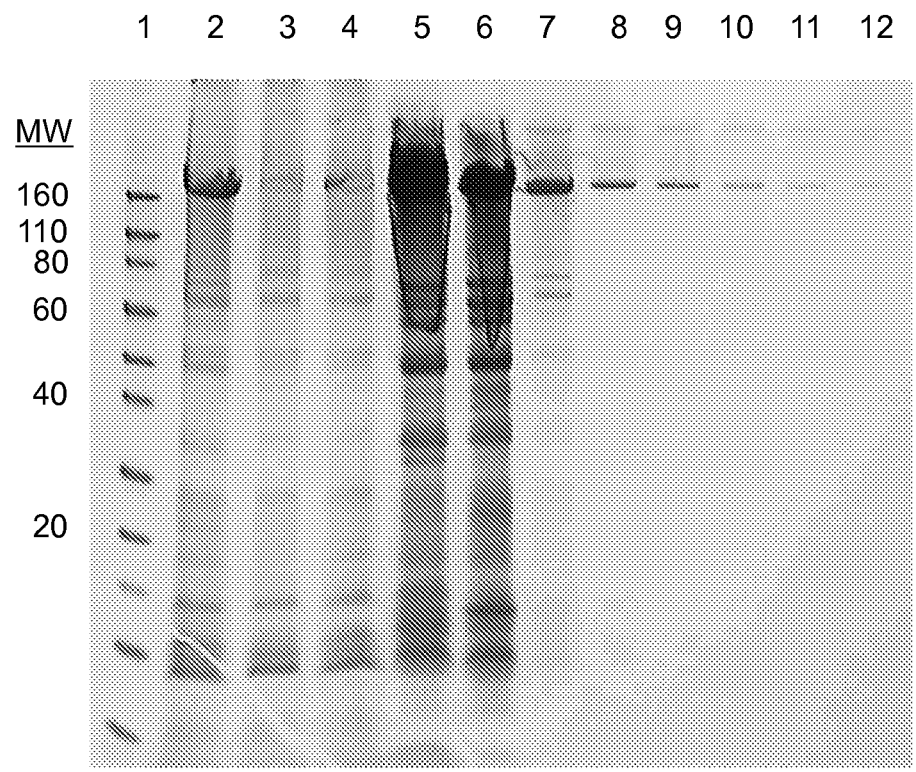
FIG. 47 shows a non-reducing 4-12% Bis-Tris SDS-PAGE analysis of Toyopearl Phenyl 650 M Hydrophobic Interaction Chromatography fractions, as indicated in the figure and as described in Example 18. The materials per lane are: Lane 1: Marker; Lane 2: Load 7.5 µl; Lane 3: Flow-through 1; Lane 4: Flow-through 2; Lane 5: Elution fraction E1; Lane 6: Elution fraction E2; Lane 7: Elution fraction E3; Lane 8: Elution fraction E4; Lane 9: Elution fraction E5; Lane 10: Elution fraction E6; Lane 11: Elution fraction E7; Lane 12: Elution fraction E8.

Samples were analyzed by 4-12% Bis-Tris SDS-PAGE (non-reducing) to determine elution pool (FIG. 47). Based on the following gel elution, fractions E1, E2, E3 & E4 were pooled for further processing. The total protein was estimated to be 85 mg in HIC elution pool, with a 65% step yield determined by running another quantitation gel.

3. Polishing/Capture Step: Toyopearl IMAC Chromatography

IMAC affinity chromatography was used as a capture step for binding to intact C-terminal His-tag of XTEN. A chromatography column XK26 was packed with Toyopearl IMAC 650 M (Part #0014907, TOSOH Biosciences) with 15 cm bed height (85 ml Column volume). The column was equilibrated with 2 column volume of 20 mM sodium phosphate, 10 mM imidazole, 0.25 M NaC, pH 8.0 (equilibrium buffer). IMAC load was prepared by adding SM NaCl to the HIC elution pool to make 0.25 M NaCl in the final volume. The sample was loaded on IMAC resin at 4 ml/min flow rate. The load was completed by 2 column volumes of equilibrium buffer. Resin was washed with 2 column volumes of 20 mM Sodium Phosphate, 10 mM Imidazole, pH 8.0 to remove salt. A linear elution was performed from 0 to 100% B in 7 column volume with buffer A (20 mM Sodium Phosphate, 10 mM Imidazole, pH 8.0) and buffer B (20 mM Sodium Phosphate, 200 mM imidazole, pH 8.0) followed by 2 CV of 100% B. Presence of imidazole maintained UV 215 absorbance above 3500 mAu with AKTA FPLC, so an elution peak was not observed. The flow through, wash and elution fractions were analyzed by 4-12% Bis-Tris non-reducing SDS-PAGE gel (FIG. 48). The gel shows the successful removal of host cell protein and truncated XTEN species (FIG. 48A). Based on the second gel (FIG. 48B), fractions CS, C6 & C7 were pooled. A total of 70 mg of protein was estimated in the IMAC elution pool.

4. Trypsin Digestion of IMAC Elution Pool

Figure 49:
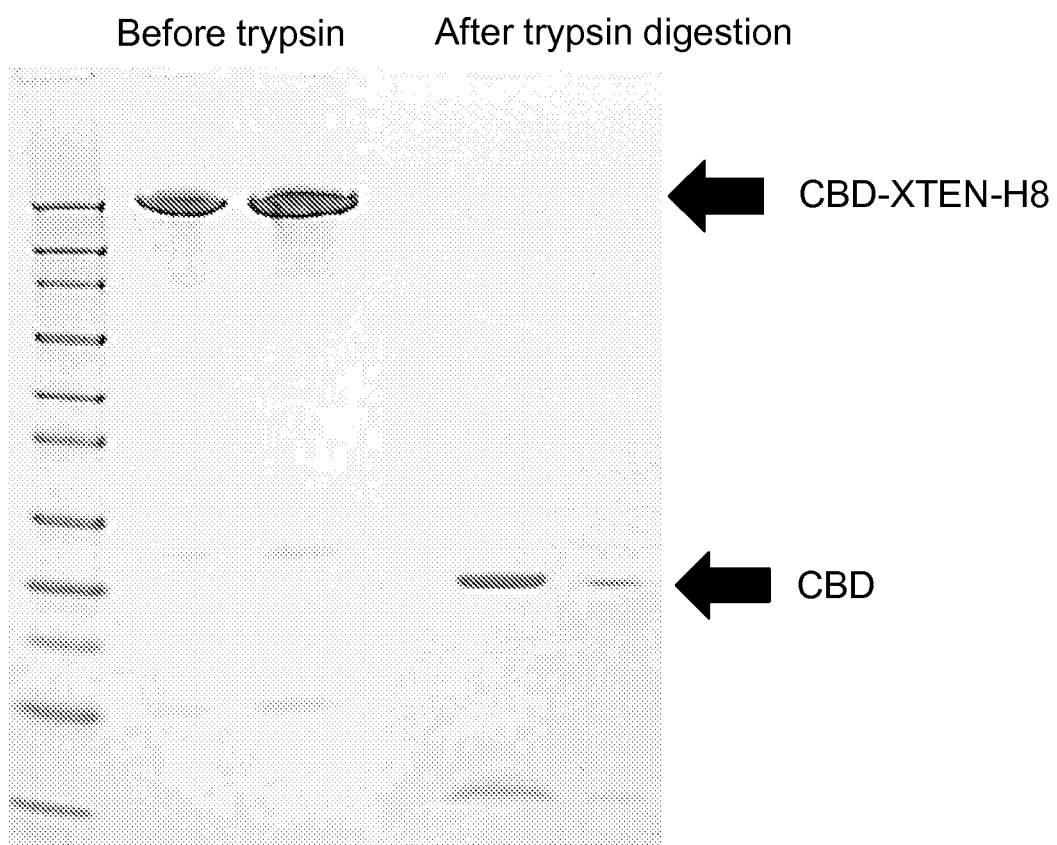
FIG. 49 shows a non-reducing SDS-PAGE analysis of the trypsin-digested IMAC pool described in Example 18.

Trypsin digestion of IMAC elution pool was performed at a 1:200 m/m ratio. 0.35 mg of bovine trypsin from pancreas (Sigma, cat # T1426) was incubated with 70 mg of Protein (IMAC elution pool) overnight at 37° C. Non-reducing 4-12% Bis-Tris SDS-PAGE analysis was performed to confirm that cleavage of the CBD tag was completed as shown in FIG. 49.

5. Polishing Step: MacroCap Q Chromatography

Figure 50:
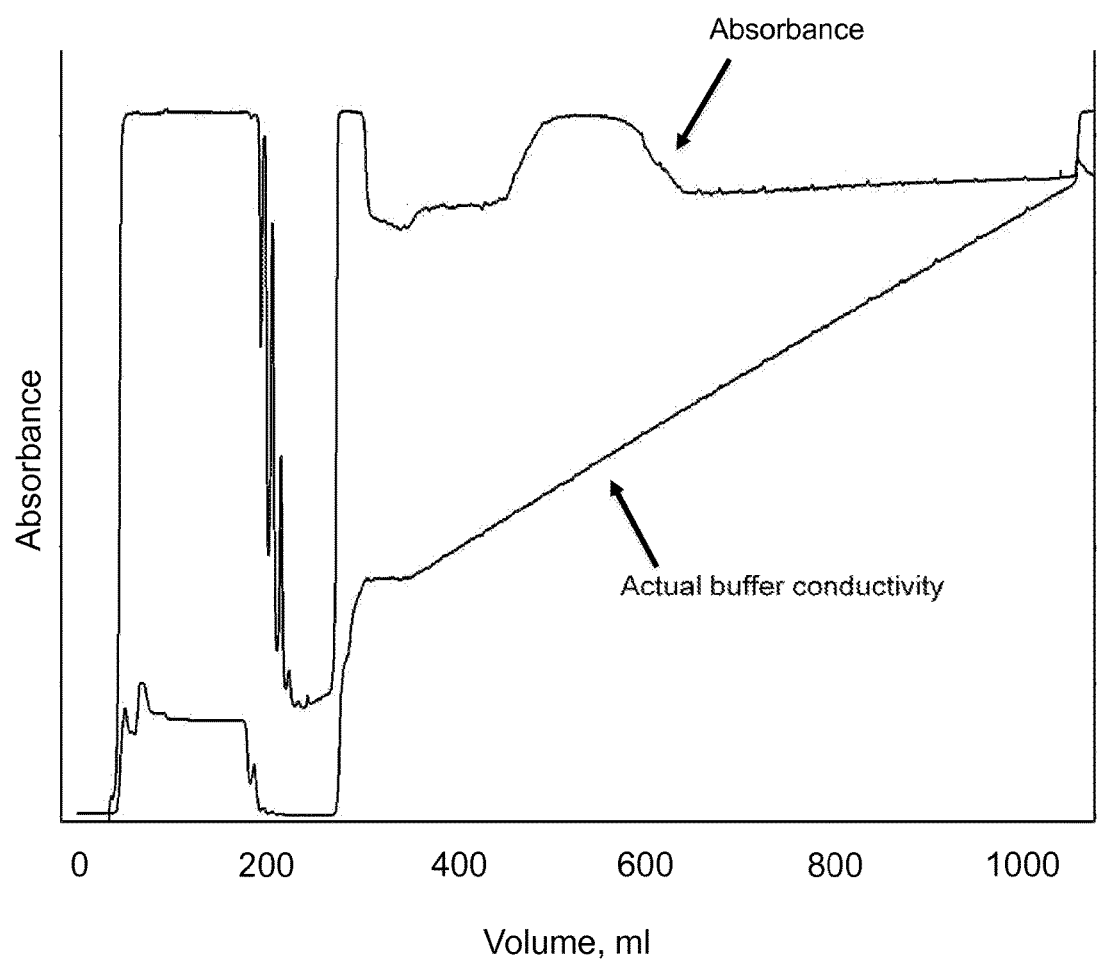
FIG. 50 shows the elution profile of the MacroCap Q Chromatography described in Example 18.
Figure 51:
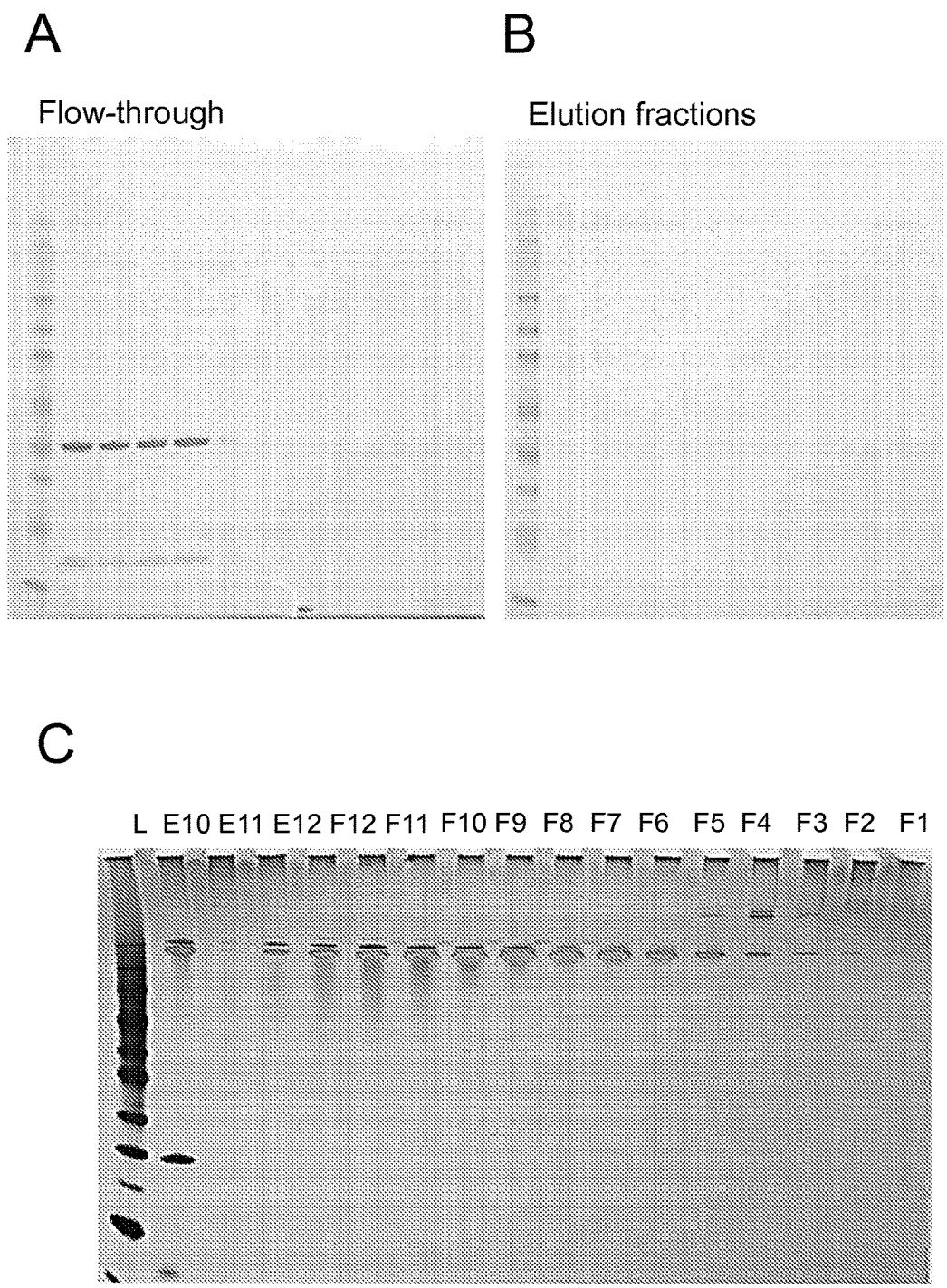
FIG. 51 shows a 4-12% Bis-Tris SDS-PAGE analysis of the MacroCap Q elution fractions, as described in Example 18.
Figure 52:
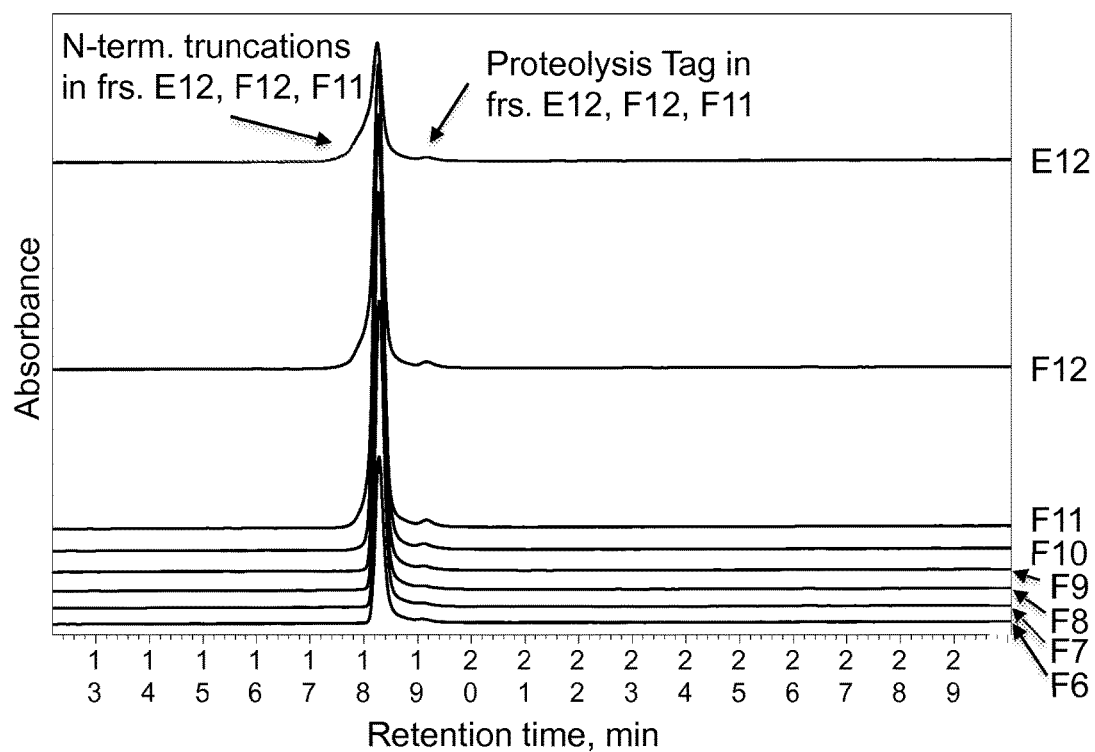
FIG. 52 shows the traces from C18 RP-HPLC analysis of MacroCap Q elution fractions, as described in Example 18.
Figure 53:
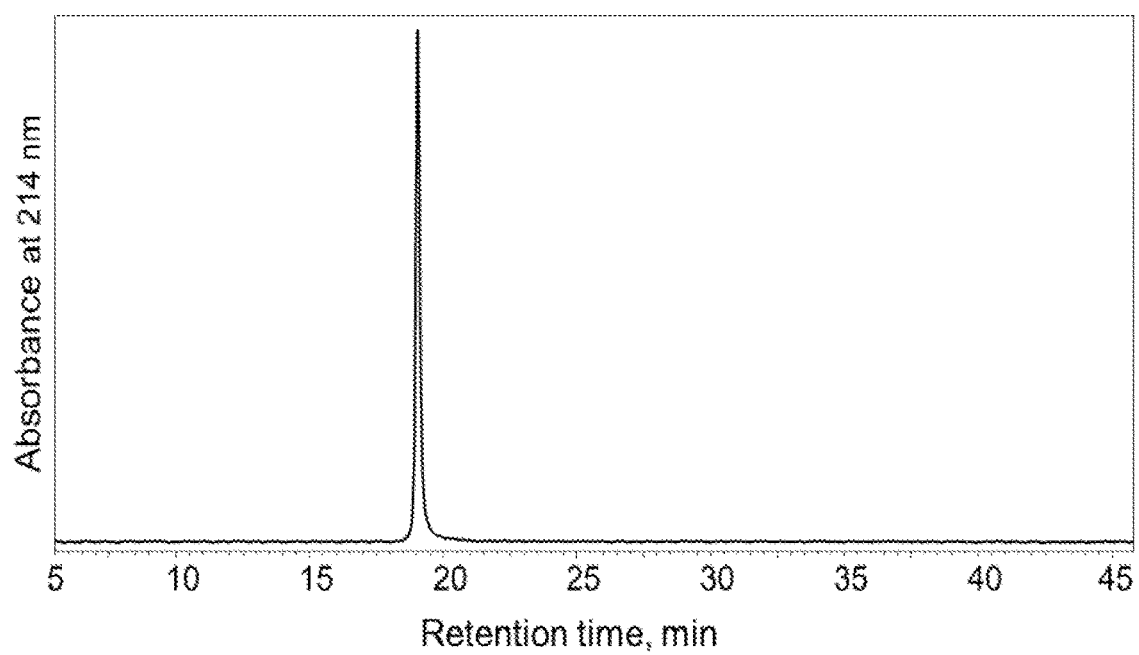
FIG. 53 shows a trace from a C18 RP-HPLC of the MacroCap Q Elution Pool, as described in Example 18.

After trypsin digestion, cleaved tags were separated using MacroCap Q chromatography. An XK 16 column was packed with 18 cm bed height with MacroCap Q (GE Life Sciences, Cat#17-5469-02). Trypsin digested IMAC elution pool was incubated for 1 hour at 37°C with 2 mM TCEP to reduce dimers of XTEN prior to loading on MacroCap Q column. Column was equilibrated with 20 mM HEPES, pH 7.0. The sample was loaded at 4 ml/min (~2 mg/ml resin load). Column loading was completed with additional 2 column volume of 20 mM HEPES, 2 mM TCEP pH 7.0. The column was washed with 2 column volumes of (20 mM HEPES, 2 mM TCEP, 150 mM NaCl pH 7.0). A linear gradient elution from 150 mM NaCl to 500 mM NaCl in 20 mM HEPES, 2 mM TCEP, pH 7.0 buffer was performed over 20 column volumes. UV 215 was observed at a high level during the entire chromatography (FIG. 50) due to presence of TCEP, but the elution peak was observed between 22 to 30 mS/cm. All samples were analyzed by SDS-PAGE, silver staining and C18 RP-HPLC. Removal of cleaved CBD was observed in the flow through (FIG. 51A), while very faint bands of XTEN were observed in elution fractions (FIG. 51B) in elution fractions E1, E12, F12, F11, F10 . . . F6). Separation of truncation species of XTEN were observed by silver staining in earlier elution fractions E11, E12, F12 & F11 as species migrating faster than the main XTEN polypeptide (FIG. 51C). Based on the above results, elution fractions were further analyzed by C18 RP-HPLC. FIG. 52 shows the stacked chromatography profiles of the RP-HPLC analysis. Earlier elution fractions had wide leading shoulder indicating significant presence of truncated species. Also, these earlier fractions (E12, F12 & F11) were enriched with proteolysis tags. Based on the above analysis, elution fractions F10, F9, F8, F7 and F6 were pooled. The elution pool was analyzed again by C18 RP-HPLC (FIG. 53). The purified protein was found to be 97.5% pure.

6. Concentration and Diafiltration (Final Formulation)

The above MacroCap Q pool was concentrated using Amicon Ultracel-15 (MWCO 10k) centrifugal device to 5 ml followed by 7× diafiltration with 20 mM HEPES pH 7.0 to a final protein concentration of 8.13 mg/ml. Total of 43 mgs of protein was purified from 20 gm of cell pellet. The overall recovery for three step chromatography was estimated at ~33%.

Example 19: Purification of 1×Amino-XTEN Reagent with CBD and His8 Tags (SEQ ID NO: 20)

Figure 54:
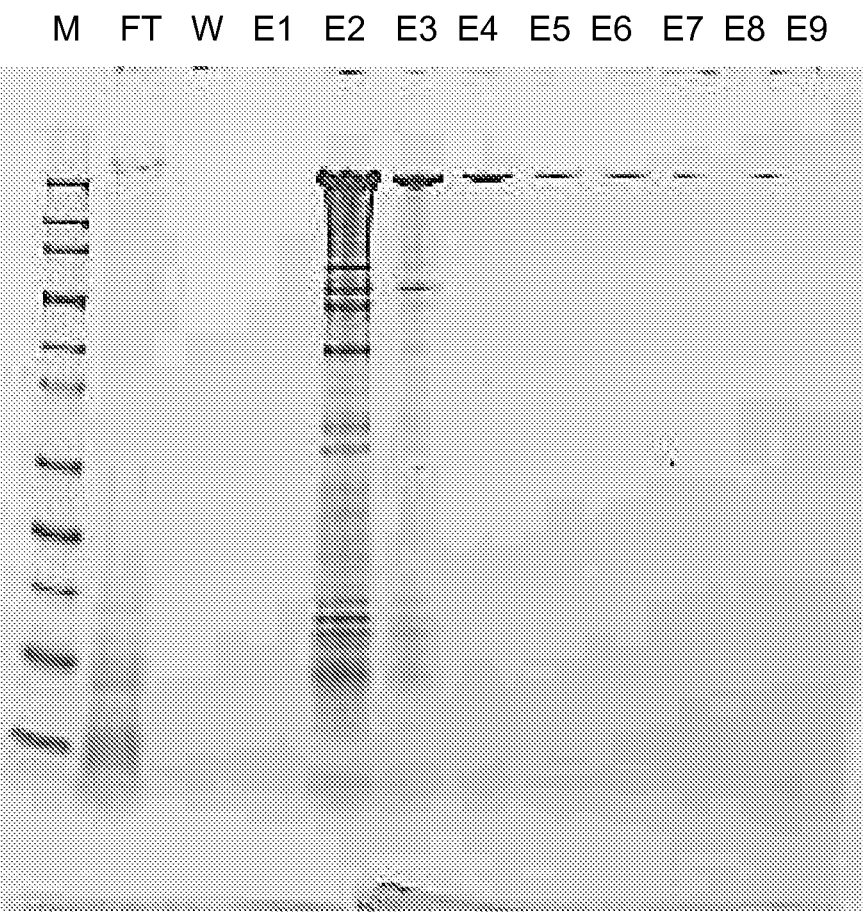
FIG. 54 shows a non-reducing SDS-PAGE analysis of the Toyopearl Phenyl 650 M Hydrophobic Interaction Chromatography fractions, as described in Example 19.
Figure 55:
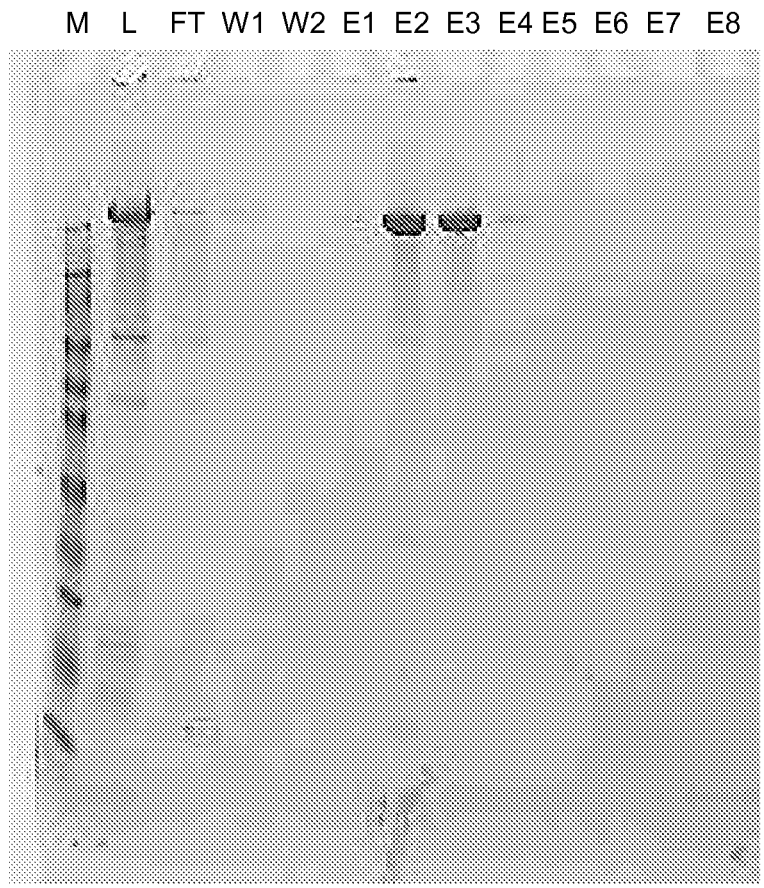
FIG. 55 shows a non-reducing SDS-PAGE analysis of Toyopearl IMAC Chromatography fractions, as described in Example 19.
Figure 56:
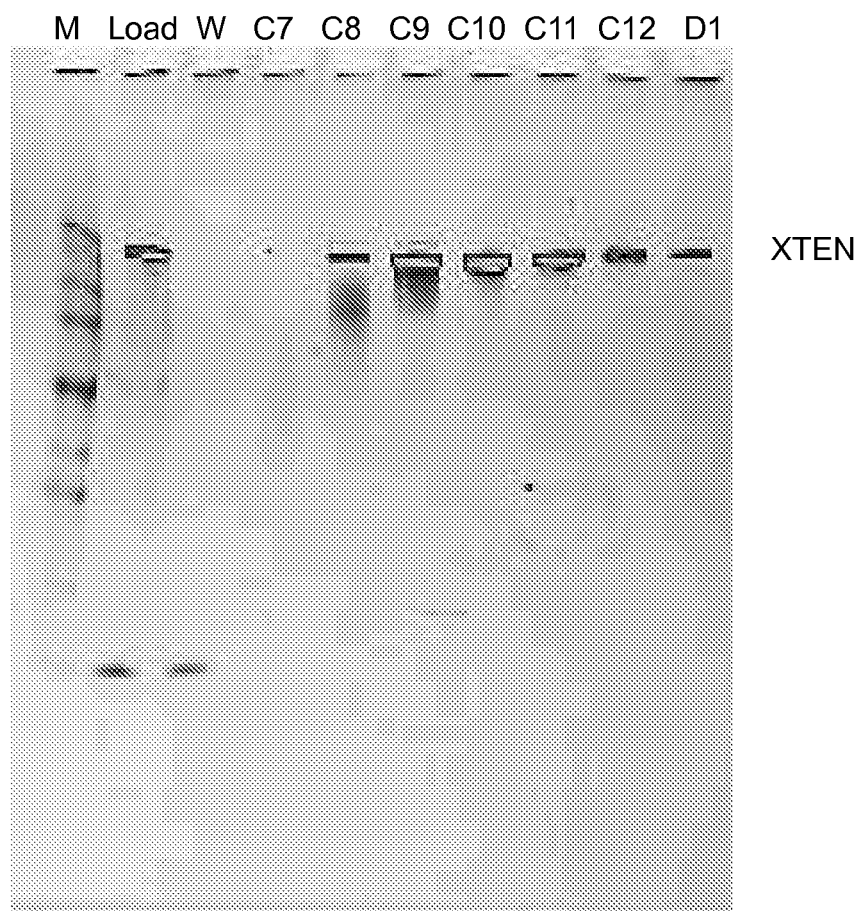
FIG. 56 shows a non-reducing 4-12% Bis-Tris SDS-PAGE/silver staining analysis of the MacroCap Q Elution fractions as described in Example 19.
Figure 57:
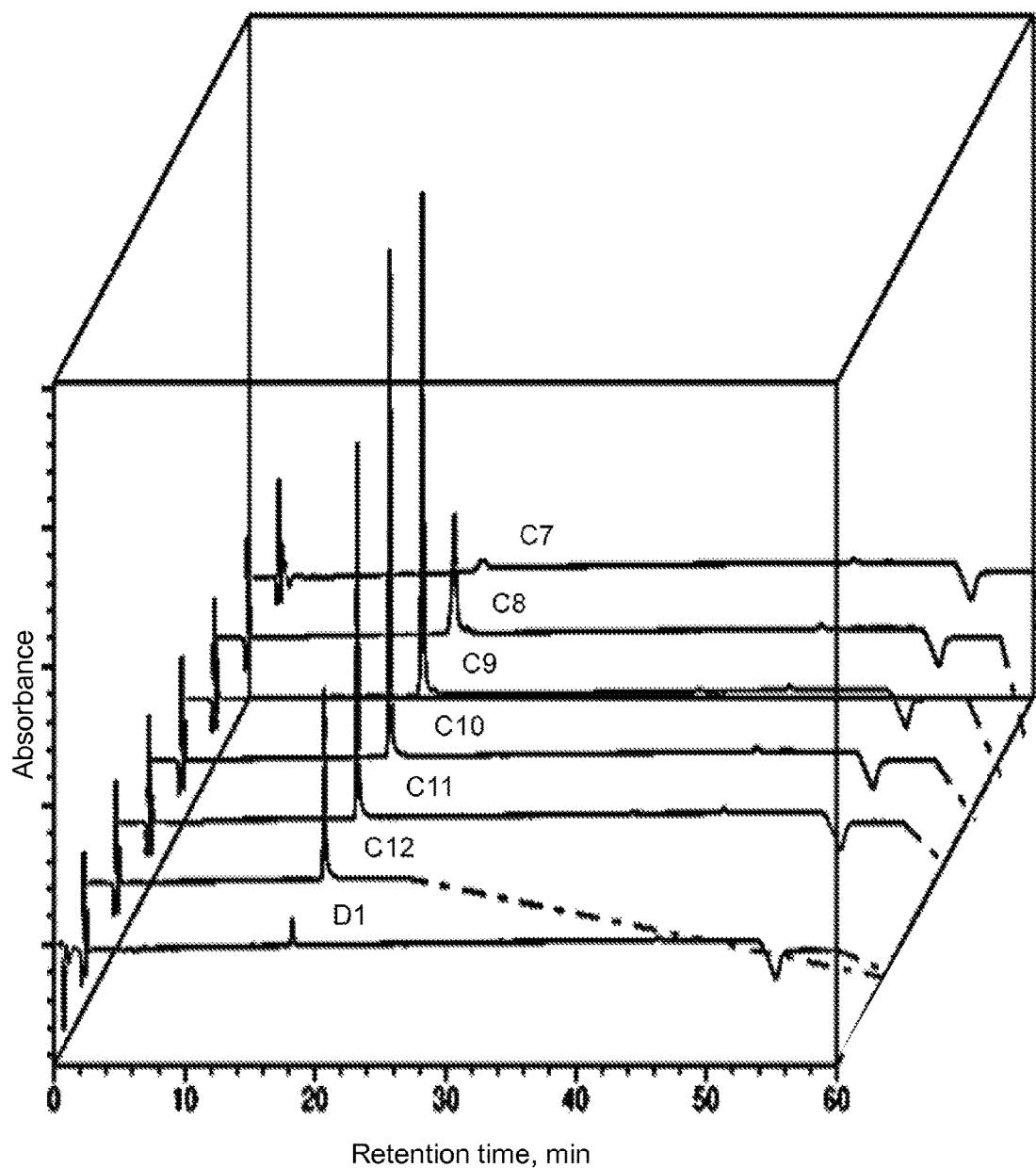
FIG. 57 shows traces from C18 RP-HPLC analysis of MacroCap Q elution fractions, as described in Example 19.
Figure 58:
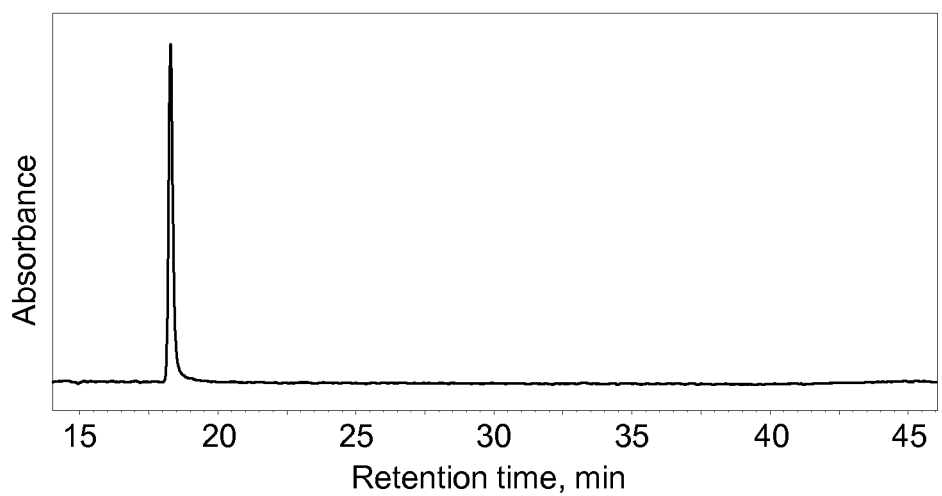
FIG. 58 shows the trace from C18 RP-HPLC analysis of the MacroCap Q elution pool described in Example 19.

Purification of amino-XTEN was performed essentially as described for the purification of the 1×Thiol-XTEN containing one cysteine (see Example 15 for details). 20 gm of cell paste from fermentation was homogenized in 100 ml of 20 mM sodium phosphate, pH 8.0 (Lysis Buffer), heat treated and clarified by centrifugation and filtration. Hydrophobic interaction chromatography was used as a first step to capture N-terminal intact protein (FIG. 54). Fractions E2, E3, & E4 were pooled for further processing. IMAC affinity chromatography was used as a capture step to bind intact C-terminal His-tag of XTEN (FIG. 55). Fractions E2 and E3 were pooled. Trypsin digestion of IMAC elution pool was performed at 1:200 m/m ratio overnight at 37° C. After trypsin digestion cleaved tags were separated using Macro-Cap Q chromatography. Fractions were analyzed by SDS-PAGE followed by silver staining (FIG. 56) and C18 RP-HPLC (FIG. 57). Based on above analysis elution fractions C10, C11 and C12 were pooled. Elution pool was analyzed again by C18 RP-HPLC (FIG. 58). Protein was found to be >98% pure. MacroCap Q pool was concentrated using Amicon Ultracel-15 (MWCO 10k) centrifugal device at 3000 RPM to 5 ml followed by 7× diafiltration with 20 mM HEPES pH 7.0 to final protein concentration to 5.35 mg/ml.

Figure 59:
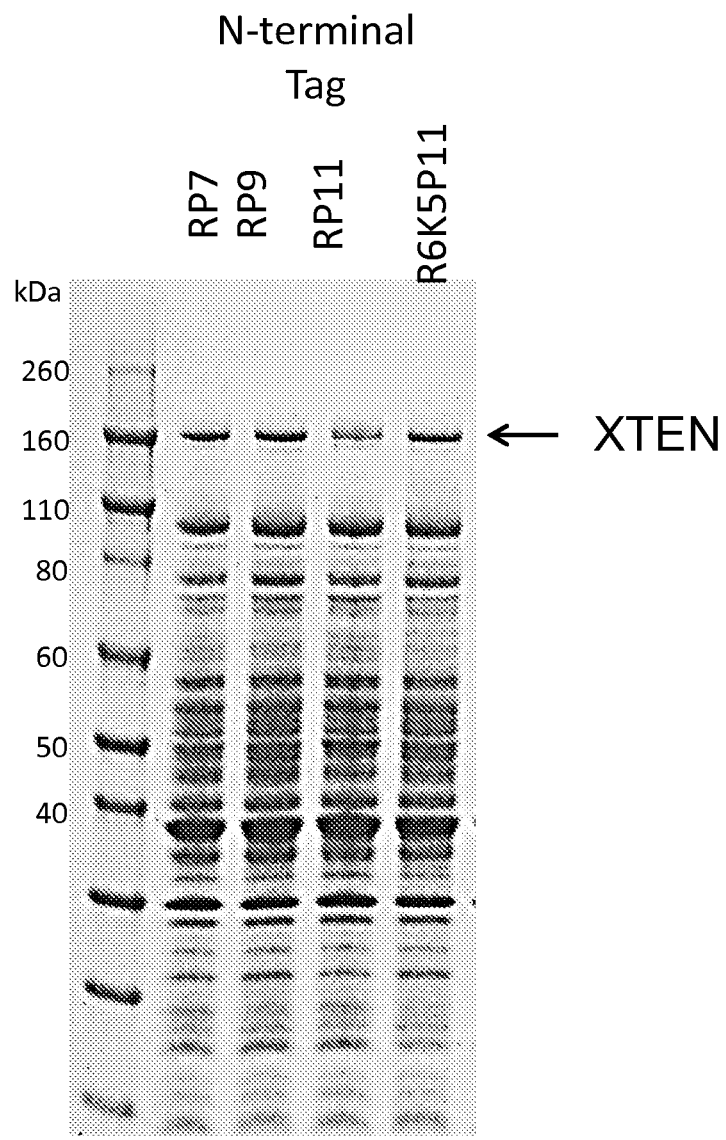
FIG. 59 shows an SDS-PAGE analysis of XTEN constructs with experimental tags after expression in E. coli as described in Example 20. Soluble lysates were loaded on the 4-12% Bis-Tris polyacrylamide gel, with amounts loaded per lane equivalent to 36 µl of cell culture suspension. The gel was stained with Coomassie Blue stain using standard methods.

Example 20: Purification and Assessment of RP11/His8-XTEN ("His8" Disclosed as SEQ ID NO: 20) Two-Tag System Using expression vectors as described above, two-tagged XTEN proteins were constructed to encode fusion proteins with the following amino acid sequences or components: MKIKTGARILALSALTTMMFSASALAAPTAGAG-Tag-XTEN_AE869(Am1)-RHHHHHHHH ("MKIKTGARI-LALSALTTMMFSASALAAPTTAGAG" and "RHHHHH-HHH" disclosed as SEQ ID NOS 1091 and 1092, respectively), where: MKIKTGARILALSALTMMF-SASALA (SEQ ID NO: 1093) is a MalE recognition sequence that is cleaved from the polypeptide expressed and transported to the host cell periplasm, APTTAGAG (SEQ ID NO: 1094) is a spacer, and Tag is from the following (tag name followed by sequence in parentheses): RP5 (RPRPRPRPRPGR) (SEQ ID NO: 1095); RP7 (RPRPRPRPRPRPRPGR) (SEQ ID NO: 1096); KP5 (KPK-PKPKPKPGR) (SEQ ID NO: 1097); RP9 (RPRPRPRPRPRPRPRPRPGR) (SEQ ID NO: 1098); RP11 (RPRPRPRPRPRPRPRPRPRPRPGR) (SEQ ID NO: 1099); P5K4P9 (RPRPKPRPKPRPKPRPKPGR) (SEQ ID NO: 1100); and R6K5P11 (RPRPKPRPKPRPKPRPKPRPK-PGR) (SEQ ID NO: 1101). All variations of the contructs with tags were made and the proteins were expressed in E. coli using the methods as described in Example 15. Soluble extracts were prepared from the host cell for SDS-PAGE/ Coomassie staining analysis. By analysis, the N-terminal tag length and amino acid composition did not affect protein expression noticeably (see FIG. 59) for expression of constructs with RP7, RP9, RP11 and R6K5P11 tags. Expressed proteins with the RP5, RP7, RP9 and RP11 tags proteins were further tested for binding to MacroCap SP resin. Proteins with longer tags bound more efficiently to cation exchange resin, and remained bound under more stringent wash conditions. Thus RP11 tag was selected as N-terminal tag for purification of XTEN using cation exchange chromatography. An additional experiment showed that RP11-

Figure 60:
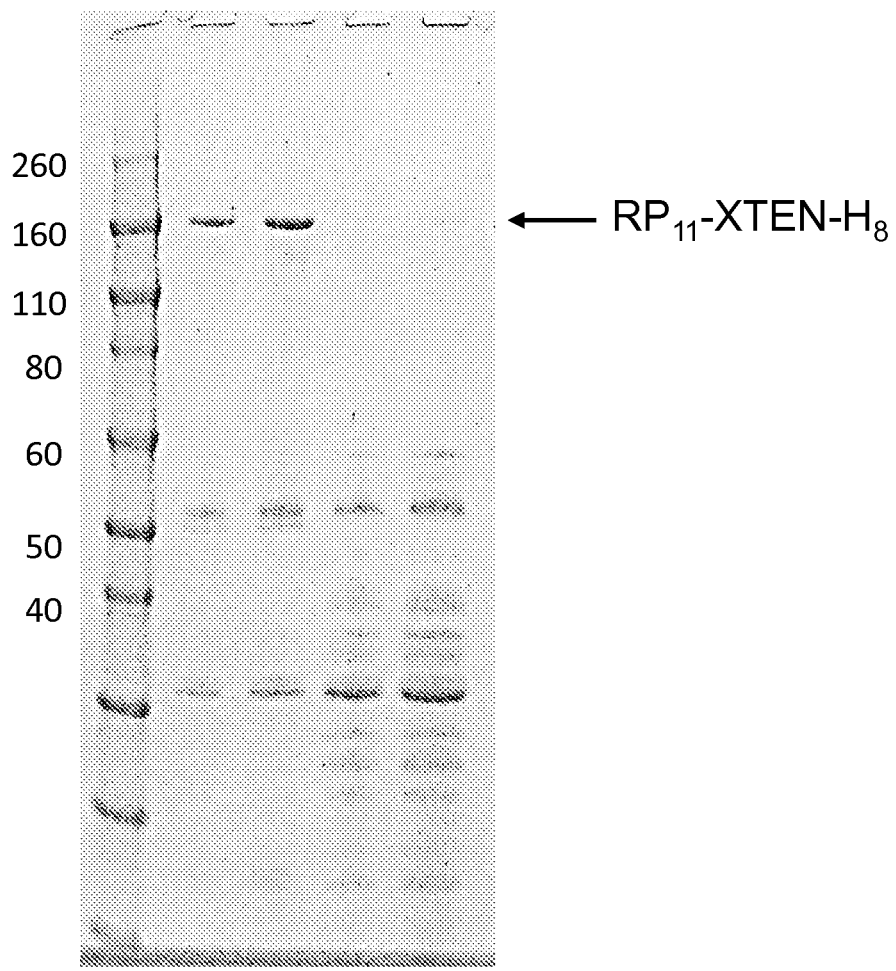
FIG. 60 shows an SDS-PAGE analysis of the RP11-XTEN-His8 ("His8" disclosed as SEQ ID NO: 20) construct expressed in E. coli, as described in Example 20. Heat-treated soluble lysates were loaded on the 4-12% Bis-Tris polyacrylamide gel with amounts equivalent to 1 or 2 µl of cell culture suspension, respectively. The gel was stained with Coomassie Blue stain. The gel demonstrates that essentially all the expressed RP11-XTEN-His8 ("His8" disclosed as SEQ ID NO: 20) protein was found in the pelleted fraction.

XTEN-His8 ("His8" disclosed as SEQ ID NO: 20) polypeptide was efficiently expressed in fermenter and most of the expressed protein was found in the cell pellet fraction (FIG. 60).

Example 21: Purification of 1×Amino-XTEN Reagent with RP11/H8 ("H8" Disclosed as SEQ ID NO: 20) Two-Tag System 1. Expression The RP11-XTEN-His8 ("His8" disclosed as SEQ ID NO: 20) precursor of 1×Amino-XTEN was produced by expression in transformed *E. coli* using a 4 L fermentation reaction as described. Cells were harvested by centrifugation and frozen at −80° C. until use.

2. Lysis and Clarification 25 g of cell paste was resuspended in 75 mL of 20 mM sodium phosphate pH 8.0, 50 mM NaCl, 2 mM EDTA. Lysis was performed by passing the resuspended paste through a homogenizer at 800-900 bar three times. Homogenate was held at 85° C. in a water bath for 15 min before it was quickly cooled down using an ice/water bath until the temperature dropped to below 10° C. The treated homogenate was then centrifuged at 10,000 rpm in SLA-3000 rotor for 60 minutes. Supernatant was collected and filtered using a 0.22 μm bottletop filter.

3. Cation Exchange Capture Step

Figure 61:
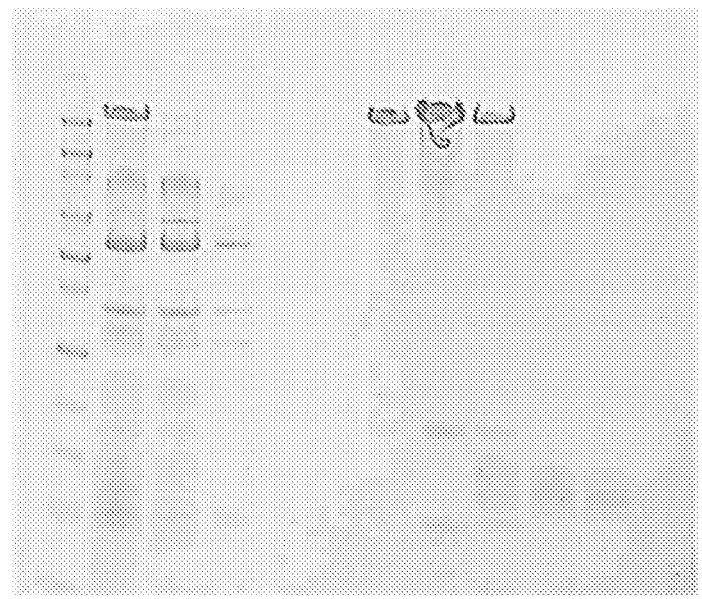
FIG. 61 shows an SDS-PAGE analysis of the MacroCap SP purification of RP11-XTEN-His8 ("His8" disclosed as SEQ ID NO: 20) polypeptide described in Example 21. Fractions were analyzed by 4-12% SDS-PAGE followed by Coomassie staining.

Cation exchange chromatography was used as a capture step to ensure N-terminal integrity of the product. MacroCap SP resin (GE Healthcare) was selected among several cation exchange media due to its superior capacity and selectivity for the product. A 20 mL MacroCap SP column was packed in a Redi-Sep housing and equilibrated with 20 mM sodium phosphate (pH 8.0), 20 mM NaCl buffer. The lysate was loaded onto the column by gravity. Three column volumes (CV) of 20 mM sodium phosphate pH 8.0, 100 mM NaCl was applied as the wash step before protein was step-eluted with 3 CVs of 20 mM sodium phosphate pH 8.0, 500 mM NaCl. Half CV fractions (10 mL) were collected for elutions and analyzed by 4-12% Bis-Tris SDS/PAGE (FIG. 61). Elution fractions 2-4 were combined for the subsequent chromatography step.

4. IMAC Polishing Step

Figure 62:
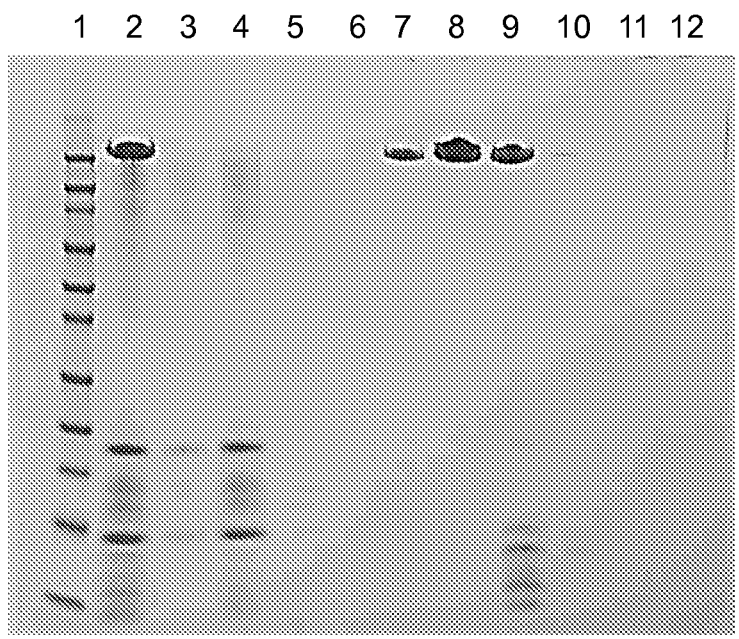
FIG. 62 shows an SDS-PAGE analysis of the IMAC purification of the RP11-XTEN-His8 ("His8" disclosed as SEQ ID NO: 20) polypeptide described in Example 21. Fractions were analyzed by 4-12% SDS-PAGE followed by Coomassie staining.

A 20-mL ToyoPearl AF-Chelate column was packed in a Redi-Sep column housing and charged with 100 mM nickel sulfate. The column was equilibrated with 20 mM sodium phosphate pH 8.0, 500 mM NaCl before the MacroCap SP pool was loaded onto the column by gravity. Two wash steps were applied using 20 mM sodium phosphate (pH 8.0), 500 mM NaCl, 5 mM imidazole buffer followed by 20 mM sodium phosphate (pH 8.0), 5 mM imidazole. Product was then eluted from the column using 20 mM sodium phosphate, 100 mM imidazole and half CV (10 mL) fractions were collected for 4 CVs of elution. Samples from each step were examined by 4-12% Bis-Tris SDS/PAGE (FIG. 62). Based on the gel, elutions 2 and 3 were pooled for further processing. The overall yield was 30%.

5. Trypsin Digestion of IMAC Elution Pool

Trypsin digestion of the IMAC pool was performed at 1:200 and 1:500 m/m ratio by adding 1 mg/mL bovine trypsin (Sigma, Cat # T1426, Trypsin from Bovine Pancreas) to the IMAC pool. The reaction mixtures were held at 37° C. overnight and the completion of digestion was confirmed by MALDI-TOF mass spectrometry. Pre- and post-digest samples were analyzed by 4-12% Bis-Tris SDS/PAGE stained by both Coomassie and silver stain (FIG. 63). Fainter staining on Coomassie-stained gel as well as the shifting of the molecule weight for the post-digestion samples, when compared to pre-digestion sample, indicates the successful removal of both N- and C-terminal tags. A silver stained gel showed homogeneous bands after digestion, suggesting the absence of truncated species in the sample, supporting the conclusion that the RP11/H8 ("H8" disclosed as SEQ ID NO: 20) two-tag system and purification methods provides a homogeneous final XTEN product.

Example 22: Purification of XTEN with RP11 and His8 (SEQ ID NO: 20) Affinity Tags 1. Expression The fusion protein RP11-XTEN-His8 ("His8" disclosed as SEQ ID NO: 20), with two affinity tags linked to XTEN at the N- and C-terminus, respectively, was expressed in *E. coli* using a 4 L fermentation reaction using conditions described.

2. Lysis and Clarification

After growth, the cells were harvested by centrifugation and frozen at −80° C. until use. The cell pellet was resuspended in lysis buffer (20 mM sodium phosphate, 50 mM NaCl, 2 mM EDTA pH 8.0, 3 ml buffer per gram cell paste). The cells were lysed by passing through an APV homogenizer three times at a pressure of 830-900 bar. Lysis buffer (1 ml buffer per gram cell paste) was used as a chase to retrieve hold up volume from the homogenizer. The homogenized lysate was incubated in a water bath at 85° C. for 20 minutes, followed by quick cooling in ice water bath for 20 minutes. After the heating and cooling treatment, the lysate was centrifuged at 11000 RPM for 90 minutes in a SORVALL centrifuge. After centrifugation, the supernatant was filtered through two CUNO Bio cap 25 (BC0025L90SP08A) filters. The clarified supernatant was stored at 4° C. overnight.

3. Capture Step: Toyopearl IMAC Chromatography

IMAC affinity chromatography was used as a capture step for binding the XTEN with an intact C-terminal His-tag. Briefly, the chromatography column BPG140/12 (GE Life Sciences) was packed with 2000 ml Toyopearl IMAC 650 M resin (TOSOH Biosciences). The column was equilibrated with 2 column volumes (CVs) of equilibrium buffer (20 mM sodium phosphate, 500 mM NaCl, pH 8.0). Clarified cell lysate was adjusted to a final NaCl concentration of 500 mM using 5 M NaCl stock solution, and then was loaded onto the IMAC resin. The column was washed with 2 column volumes of equilibrium buffer, and then 2 column volumes of 20 mM sodium phosphate, 500 mM NaCl, 5 mM Imidazole pH 8.0, followed by 2 column volumes of 20 mM sodium phosphate, 5 mM Imidazole pH 8.0 to remove salt. Elution was performed with 2 column volumes of 20 mM sodium phosphate, 100 mM Imidazole, pH 8.0. The flow through, wash and elution fractions were analyzed by non-reducing 4-12% Bis-Tris SDS-PAGE/Coomassie staining and the fractions with the desired product were pooled.

4. Polishing/Capture Step: MacroCap SP Chromatography

Cation exchange chromatography was used as a polishing step to ensure the N-terminal integrity of the product. MacroCap SP resin (GE Life Sciences) was selected among several cation exchange media due to its superior capacity and selectivity for the product. 1000 ml of MacroCap SP resin was packed in a BPG100/13 (GE Life Sciences) chromatography column and equilibrated with 20 mM sodium phosphate pH 8.0, 20 mM NaCl. The IMAC pool was loaded onto the column and the resin was washed with 2 column volumes of 20 mM sodium phosphate, 50 mM NaCl, pH 8.0 and 2 column volumes of 20 mM sodium phosphate pH 8.0, 150 mM NaCl. The protein was eluted with 5 column volumes of linear gradient from 150 to 500 mM NaCl in 20 mM sodium phosphate pH 8.0. Fractions were collected and analyzed by 4-12% Bis-Tris SDS/PAGE. Fractions the with desired product were combined for the next step.

5. Trypsin Digestion of Macrocap SP Elution Pool

Trypsin (Sigma, Trypsin from Bovine Pancreas) digestion of the SP elution pool was performed at 1:200 m/m enzyme/protein ratio overnight at 37° C.

6. Polishing Step: Macrocap Q Chromatography

After trypsin digestion, the cleaved tags were separated from the final product using Macrocap Q chromatography. The BPG100/19 column (GE Life Sciences) was packed with 1500 ml column volume of Macrocap Q resin (GE Life Sciences). The trypsin digested Macrocap SP elution pool was incubated for 15 min at 80° C. with 20 mM DTT and 2 mM EDTA to reduce disulfide bonds and to inactivate trypsin. The cooled protein solution was diluted to a conductivity below 5 mS/cm with Milli-Q water and loaded onto the Macrocap Q column equilibrated with 20 mM HEPES, 50 mM NaCl, pH 7.0. The column was washed with 2 column volumes of 20 mM HEPES, 50 mM NaCl, pH 7.0, then 2 column volumes of 20 mM HEPES, 2 mM TCEP, 150 mM NaCl pH7.0. The protein was eluted with a linear gradient from 150 mM NaCl to 500 mM NaCl in 20 mM HEPES, pH 7.0 in 20 column volumes. Fractions were analyzed by SDS-PAGE/silver staining.

7. Concentration and Diafiltration (Final Formulation)

Selected MacroCap Q fractions were combined and concentrated and using 10 KD Pellicon mini (Millipore) at a feed pressure<20 psi and retentate<8 psi, followed by 10× diafiltratiion with 20 mM HEPES, 50 mM NaCl, pH 7.0 to achieve a final protein concentration of >5 mg/ml.

8. Purity Analysis of Proteins Purified with Different Methods

One batch (Batch 1) was purified through three purification steps as described above. Another batch (Batch 2) was purified from the same fermented material but the MacroCap SP polishing step was omitted. Truncated species of XTEN were detected by SDS-PAGE/silver staining in MacroCap Q elution fractions for Batch 2 (FIG. 87A), while the MacroCap Q elution fractions for Batch 1 were essentially free from truncations (FIG. 87B). These results support that, under the conditions employed, the MacroCap SP step based on the RP11 tag is essential to ensure N-terminal integrity and overall product quality and that the RP11/H8 ("H8" disclosed as SEQ ID NO: 20) two-tag system and purification methods provides a homogeneous final XTEN product.

Figure 64:
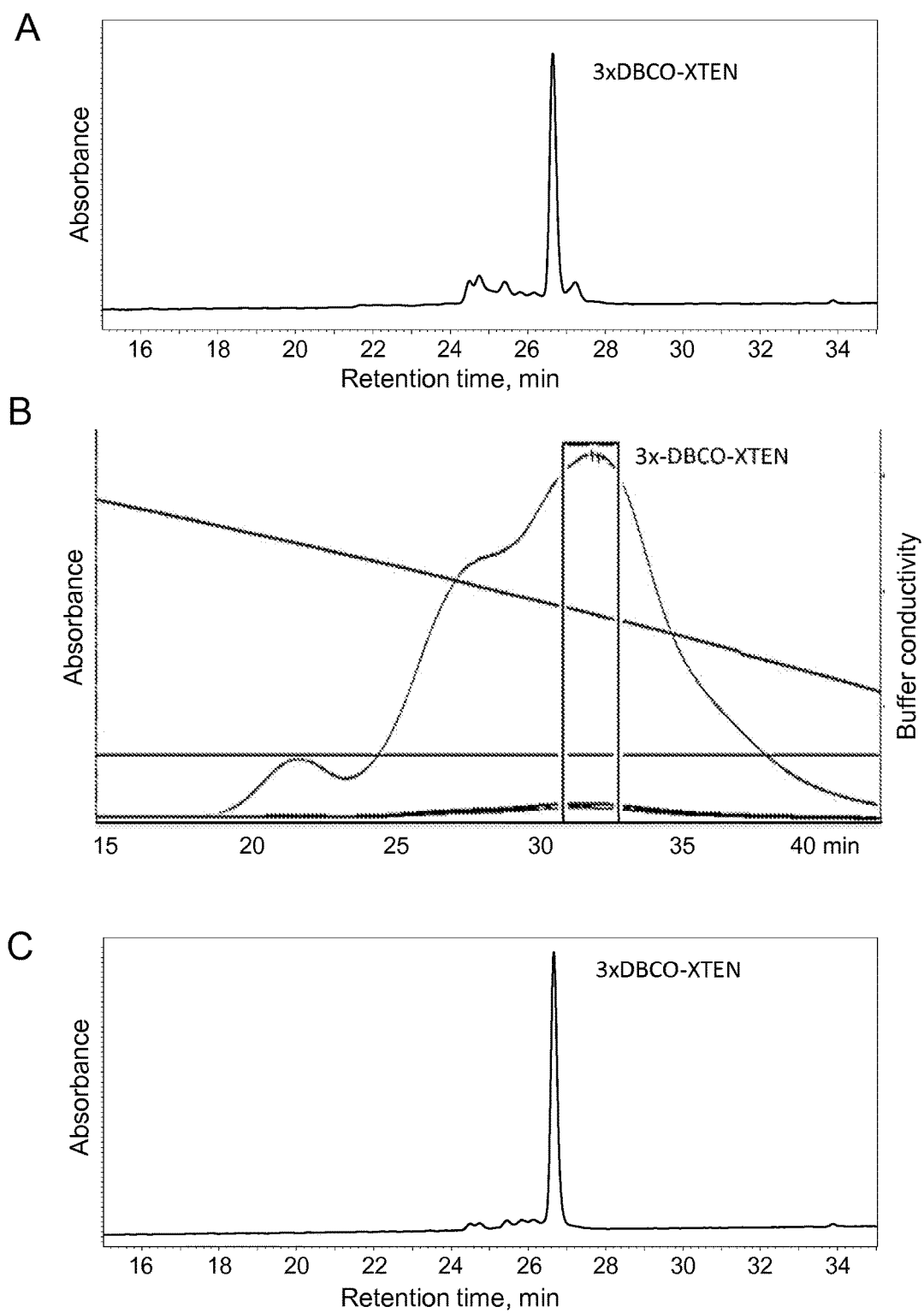
FIG. 64 shows the results of the analysis of the conjugation reaction of DBCO-Mal to the 3×Thiol-XTEN as described in Example 23.

Example 23: Conjugation of the DBCO-Mal Linker to 3×Thiol-XTEN to Make an XTEN Precursor A 3×-Thiol-XTEN (XTEN_AE905(Am1,C8,C453,C898, Seg 174)) cysteine-engineered XTEN segment was prepared for reaction as a 193 uM (16 mg/ml) solution in 20 mM HEPES, pH 7.0, 50 mM NaCl. DBCO-Maleimide (Click Chemistry Tools, Inc., cat. # A108) was dissolved in DMF to a final concentration of 50 mM. An aliquot of the 3×Thiol-XTEN (5.1 mg, 320 µl) was reduced with 10 mM freshly reconstituted DTT at 70° C. for 20 minutes. The protein sample was diluted to 600 µl total volume with water. 1200 µl of 100% acetonitrile was added and the mixture was centrifuged at 13,000 rpm for 5 minutes. The supernatant was removed, 1000 µl of 80% acetonitrile was added and the mixture was centrifuged at 13,000 rpm for 1 minute. The wash step was repeated once more. The pellet was dissolved in 300 µl 100 mM HEPES pH 7.0. A 7.7 µl 50 mM solution of DBCO-Mal in DMF was added (1:6 molar ratio of 3×Thiol-XTEN to DBCO-Maleimide) and was incubated for 2 hours at 25° C. Completion of modification was monitored by C18 RP-HPLC analysis (FIG. 64A). The protein mixture was purified by hydrophobic interaction chromatography (HIC) using a 1.6 ml Toyopearl butyl column. Elution was performed with a 30 column volume descending gradient of ammonium sulfate from 1.05 M to 0.3M in 20 mM Phosphate, pH 7.0 buffer at 0.5 ml/min flow rate (FIG. 64B). Chromatographic fractions were analyzed by C18 RP-HPLC (FIG. 64C).

Example 24: Trypsin Cleavage and Purification of Double Tagged Precursor

Trypsin Digestion

Figure 65A:
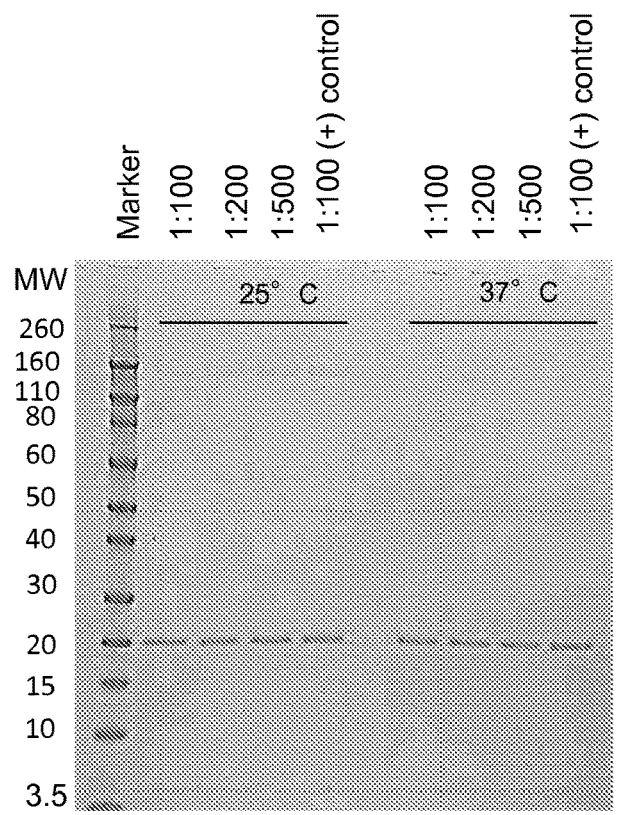
FIG. 65A shows a 4-12% Bis-Tris SDS-PAGE analysis of protein samples loaded at 2 μg per lane. The gel was stained with an Invitrogen SimplyBlue SafeStain.
Figure 65B:
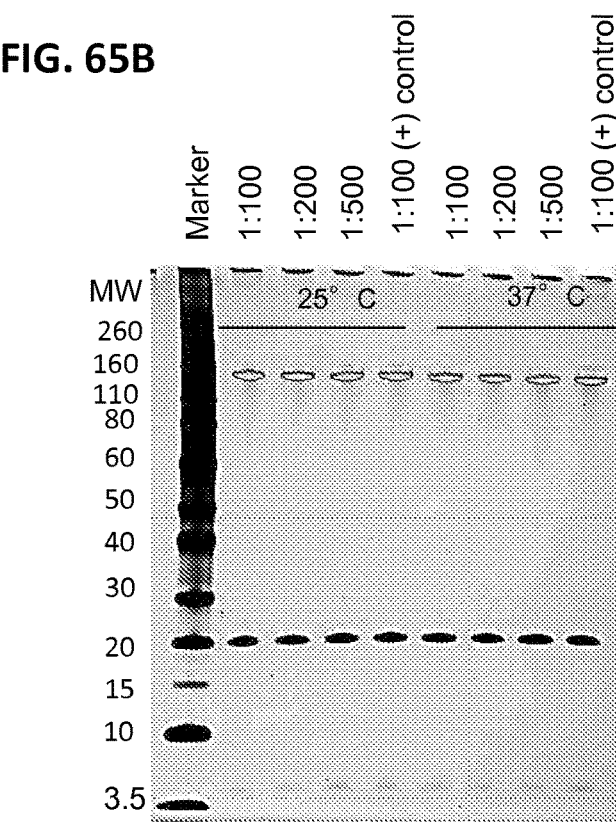
FIG. 65B shows a 4-12% Bis-Tris SDS-PAGE analysis of protein samples loaded at 0.5 μg per lane. The gel was stained with a Pierce Silver Stain Kit.

A double-tagged (CBD/His8) ("His8" disclosed as SEQ ID NO: 20) precursor of XTEN_AE870_Am1,C1 stains well with Coomassie due to the presence of CBD sequence, while a no-tagged version of XTEN_AE870_Am1,C1 stains poorly with Coomassie, but can be detected by silver staining. Therefore, trypsin digestion completeness was monitored using both Coomassie staining (FIG. 65A) and silver staining (FIG. 65B) techniques. The double tagged precursor of XTEN_AE870_Am1,C1 was digested with different ratios of bovine trypsin and proteomics grade porcine trypsin (positive control) in 20 mM phosphate buffer, pH 8. Overnight incubation at 37° C. allowed more complete digestion than overnight incubation at 25° C. based on detection of remaining Coomassie stained 160 kDa band of double tagged precursor (FIG. 65A: all ratios refer to mass/mass ratio of trypsin to substrate). FIG. 65B shows that 1:100, 1:200 and 1:500 ratio digests with bovine trypsin and 1:100 digests with porcine trypsin resulting in efficient digestion of the XTEN precursor.

MacroCap Q Purification of Trypsin Digested Double Tagged Precursor

Figure 66A:
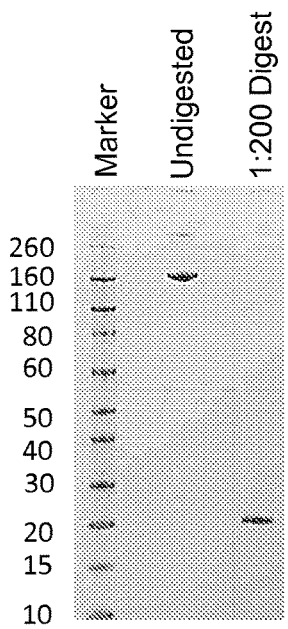
FIG. 66A shows a 4-12% Bis-Tris SDS-PAGE analysis of protein samples loaded at 3 μg per lane. The gel was stained with Invitrogen SimplyBlue SafeStain.

1:200 ratio of bovine trypsin to double tagged precursor (mass/mass) was used for digestion at 37° C. overnight FIG. 66A shows >90%/o conversion of double tagged precursor to digested product. This was demonstrated by disappearance of the Coomassie stained band at ~160 kDa after digestion and appearance of 20 kDa CBD fragment.

Figure 66B:
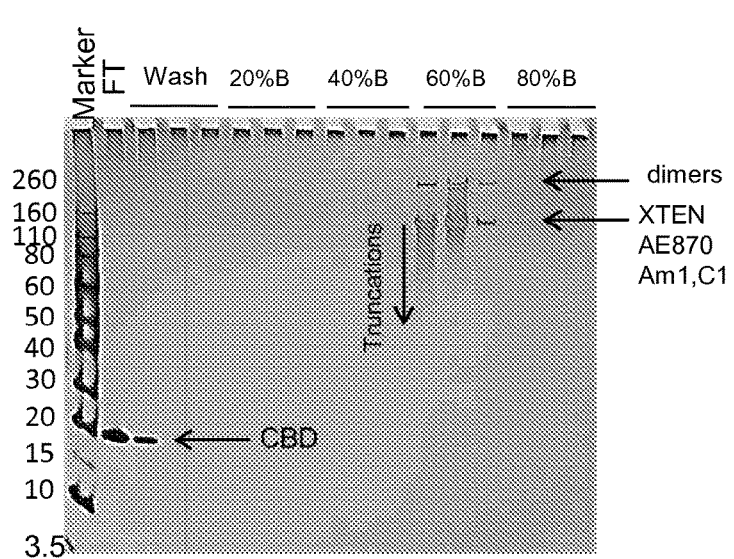
FIG. 66B shows a 4-12% Bis-Tris SDS-PAGE analysis of protein samples loads at 0.5 μg per lane. The gel was stained with a Pierce Silver Stain Kit.
Figure 66C:
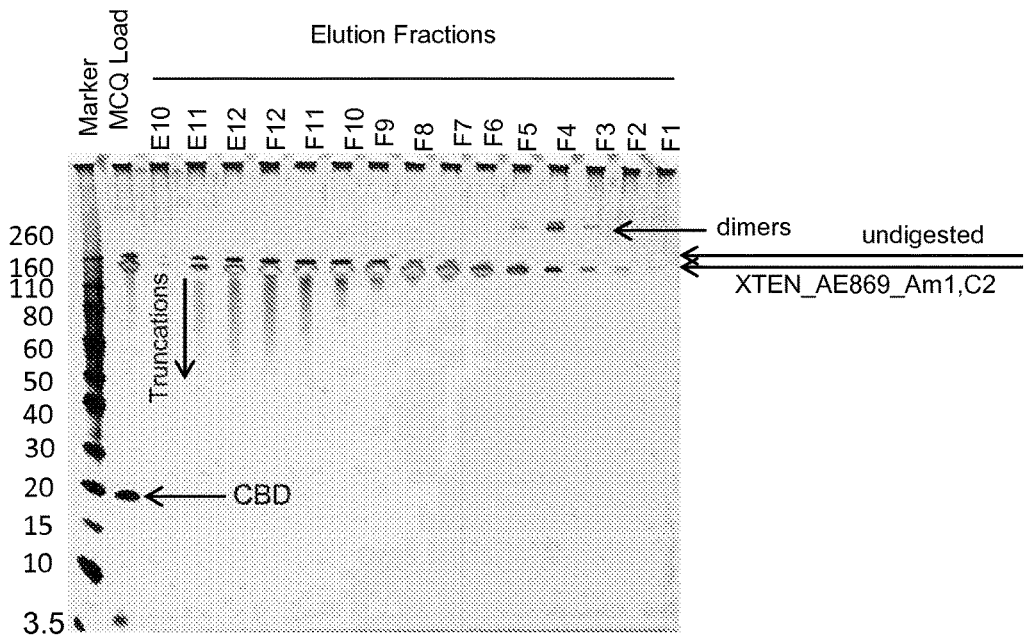
FIG. 66C shows a 4-12% Bis-Tris SDS-PAGE analysis of protein samples loaded at 0.5 μg per lane. The gel was stained with a Pierce Silver Stain Kit.

Trypsin digested material was subjected to step purification using MacroCap Q anion exchange resin and following buffers: A: 20 mM HEPES, 50 mM NaCl, pH 7.5 and B: 20 mM HEPES, 500 mM NaCl, pH 7.5. Digested material was loaded by gravity and eluted in a stepwise manner using 3 column volume washes of 0%, 20%, 40%, 60%, 800/0 and 100% Buffer B consecutively. XTEN_AE870 eluted in 60% B. FIG. 66B shows that cleaved CBD fragment did not bind to MacroCap Q under used conditions and was completely separated from XTEN. Stepwise elution of XTEN from MacroCap Q only partially separated truncated polypeptides. Better separation was achieved by gradient elution of XTEN (FIG. 66C).

Test for Residual Trypsin Activity

Figure 67:
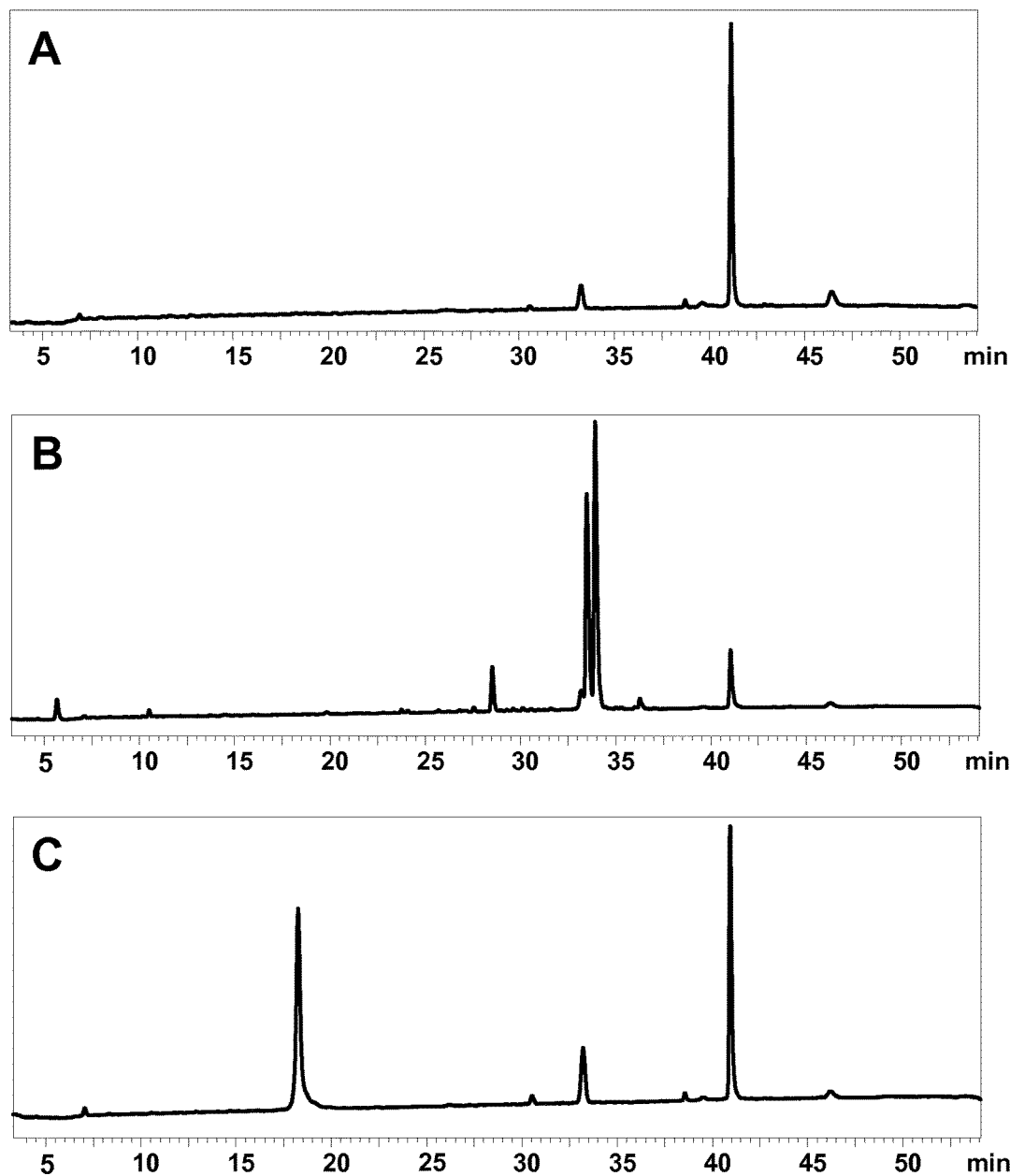
FIG. 67 shows results from a C18 RP-HPLC test for residual trypsin activity.

To test the presence of residual trypsin activity in the final formulated XTEN preparations, a protein sample was mixed with synthetic [G2]GLP2 peptide at 10:1 mass/mass ratio. A positive control for digestion contained [G2]GLP2 peptide and bovine trypsin; A negative control contained [G2]GLP2 peptide only. All samples were incubated overnight at 37° C. After incubation samples were quenched with 1% TFA and subjected to C18 RP-HPLC analysis using Phenomenex Jupiter C18 Sum 300 A analytical column. Buffer A contained 0.1% TFA, 99.9% HPLC grade $H_2O$; Buffer B contained 0.1% TFA, 99.9% HPLC grade Acetonitrile. Analysis was performed using a gradient of 5% B to 50% B over 45 min elution time. FIG. 67 shows the results of RP-HPLC analyses of residual trypsin activity in the XTEN_AE869(Am1,C2) final preparation. FIG. 67A shows the intact GLP2 peptide (41 min retention time). FIG. 67B shows tryptic digest of GLP2 peptide with two characteristic tryptic fragments(33.5 min and 34 min retention time). FIG. 67C shows that GLP2 peptide remained intact after overnight incubation with XTEN and no tryptic fragments were observed. This result indicates that final MacroCap Q purified preparations do not contain any residual trypsin activity.

Example 25: Fermentation and Purification of Cysteine-Engineered XTEN for Conjugation E. coli containing AC292 on a plasmid was grown to saturation overnight in 2×YT and then 200 ml of this culture was used to inoculate a 25 L culture of 2×YT media in a wavebag. Both cultures were in the presence of 50 µg/ml kanamycin. The second culture was grown to an OD600 of ~1.0 at 37° C., chilled to 26° C., and induced with 12 ml of 1M IPTG overnight. The cell pellet was harvested at 4000 rpm in a SLA-3000 rotor spinning for 20 minutes. The cell pellet (184 g) was resuspended in 736 ml of 20 mM Tris pH 6.8, 50 mM NaCl. The resuspended cells were lysed with a microfluidizer at 20,000 psi and then heated to 75° C. for 15 minutes, followed by rapid cooling on ice for 30 minutes. The lysate was then clarified by centrifugation. The clarified lysate was then loaded on to a DE52 column, previously sanitized with NaOH and equilibrated with 20 mM Tris pH 6.8, 50 mM NaCl. The column was washed with 5 column volumes of 20 mM Tris pH 6.8, 50 mM NaCl, 5 column volumes of 20 mM Tris pH 6.8, 150 mM NaCl and eluted with 5 column volumes of 20 mM Tris pH 6.8, 250 mM NaCl. The pooled elution fractions. were then loaded on to a macrocapQ column, previously sanitized with NaOH and equilibrated with 20 mM Tris pH 6.8, 50 mM NaCl. The column was washed with 9 column volumes of 20 mM Tris pH 6.8, 50 mM NaCl, 9 column volumes of 20 mM Tris pH 6.8, 100 mM NaCl and eluted with 9 column volumes of 20 mM Tris pH 6.8, 250 mM NaCl. The pooled elution fractions were adjusted to a 15% w/v sodium sulfate and then loaded on to a octyl sepharose FF column, previously sanitized with NaOH and equilibrated with Tris pH 7.5. The column was washed with 4 column volumes of 20 mM Tris pH 7.5 15% w/v sodium sulfate, and eluted with 4 column volumes of 20 mM Tris pH 7.5, 5% w/v sodium sulfate. The sample was stored at 4° C. and given the lot # AP197. The purified cysteine-engineered XTEN could then serve as a suitable reactant for conjugation with a payload, such as a drug from Table 11, resulting in an XTEN-drug conjugate.

Figure 68:
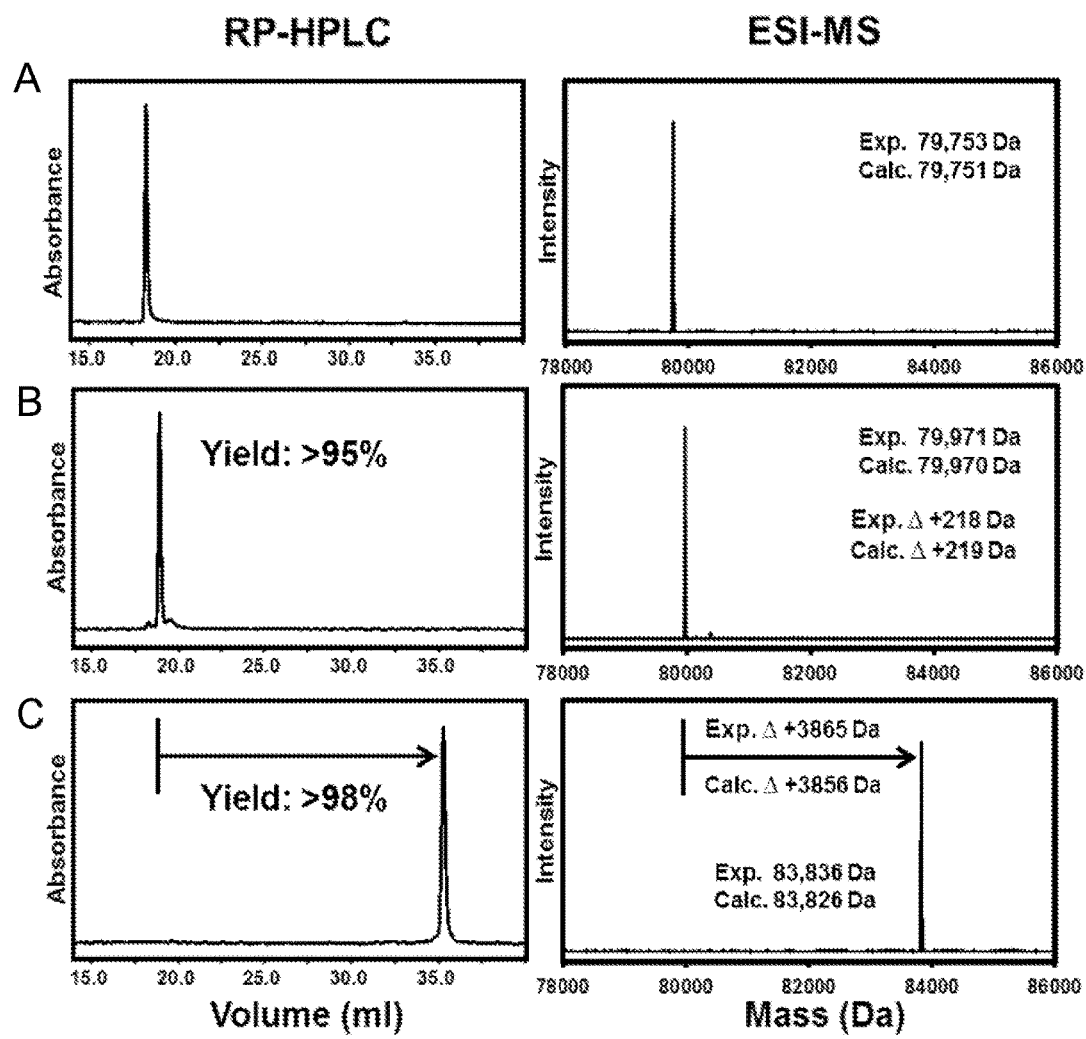
FIG. 68 shows preparation of GLP2-XTEN conjugate from GLP2-Cys peptide and 1×Amino-XTEN as described in Example 26. 20 μg protein samples were loaded on Phenomenex Jupiter C18 5 uM 300 A 4.6 mm×150 mm column. Proteins were eluted with 5-50% gradient of acetonitrile in 0.1% trifluoroacetic acid and detected by absorbance at 214 nm (left panels A-C). 100 μg protein samples were desalted using NanoSep 3K Omega centrifugal devices (Pall Corp.). Protein solutions in 50% acetonitrile, 0.5% formic acid were infused into high-resolution mass spectrometer at flow rate 10 ul/min. ESI-MS spectra were acquired in 800-1600 amu range and reconstructed into zero-charge spectra using Bayesian Protein Reconstruction Software (right panels A-C).

Example 26: Conjugation of GLP2-Cys to 1×Amino-XTEN to Result in XTEN-Payload of GLP2-XTEN A 1×Amino-XTEN (XTEN_AE869(Am1)) was prepared as 67 uM (5.35 mg/ml) solution in 20 mM HEPES, pH 7.0, 50 mM NaCl. Sulfo-SMCC (Thermo Scientific, cat. #22322) was prepared fresh as 100 mM solution in DMSO. 10 mg of amino-XTEN (1.87 ml) was mixed with 15-molar excess of sulfo-SMCC (18.7 ul) and incubated for 1 hr at 25° C. Excess cross-linker was removed by centrifugal filtration using Amicon Ultra-15, MWCO 5k centrifugal device. A volume of 1.8 ml reaction mixture was mixed with 8 ml 20 mM HEPES pH 7.0, 50 mM NaCl and centrifuged for 20 min in Sorvall RT6000 centrifuge at 3000 rpm, 4° C. The procedure was repeated two more times. Final volume of recovered retentate was 1.8 ml. The GLP2-Cys peptide (CSBio, custom synthesis) was dissolved in 20 mM HEPES pH 7.0, 50 mM NaCl to the final concentration 3 mg/ml. N-Maleimide-XTEN was mixed with 2.3-fold molar excess of GLP2-Cys peptide and was incubated for 1 hr at 25° C. Completion of the modification was monitored by C18 RP-HPLC. 20 µg protein samples were loaded on Phenomenex Jupiter C18 5 uM 300 A 4.6 mm×150 mm column. Proteins were eluted with 5-50% gradient of acetonitrile in 0.1% trifluoroacetic acid and detected by absorbance at 214 nm. Essentially all N-maleimide-XTEN was converted into GLP2-Cys-XTEN conjugate, as demonstrated by HPLC and electrospray mass spectrometry (ESI-MS analysis of samples performed on 100 µg protein samples desalted using NanoSep 3K Omega centrifugal devices (Pall Corp.). Protein solutions in 50% acetonitrile, 0.5% formic acid were infused into high-resolution mass spectometer at flow rate 1 ul/min. Spectra were acquired in 800-1600 amu range and reconstructed into zero-charge spectra using Bayesian Protein Reconstruction Software) (FIG. 68). Unreacted XTEN and GLP2 peptide were separated from the conjugate by consecutive anion exchange (MacroCap Q) and hydrophobic interaction (Toyopearl Phenyl) chromatographies. The results of RP-HPLC and MS analyses demonstrated the high yield and purity of the reactants and final product (FIG. 68).

Example 27: Conjugation of GLP2-N-Mal to 1×Thiol-XTEN (Cysteine-Engineered XTEN)

Figure 69:
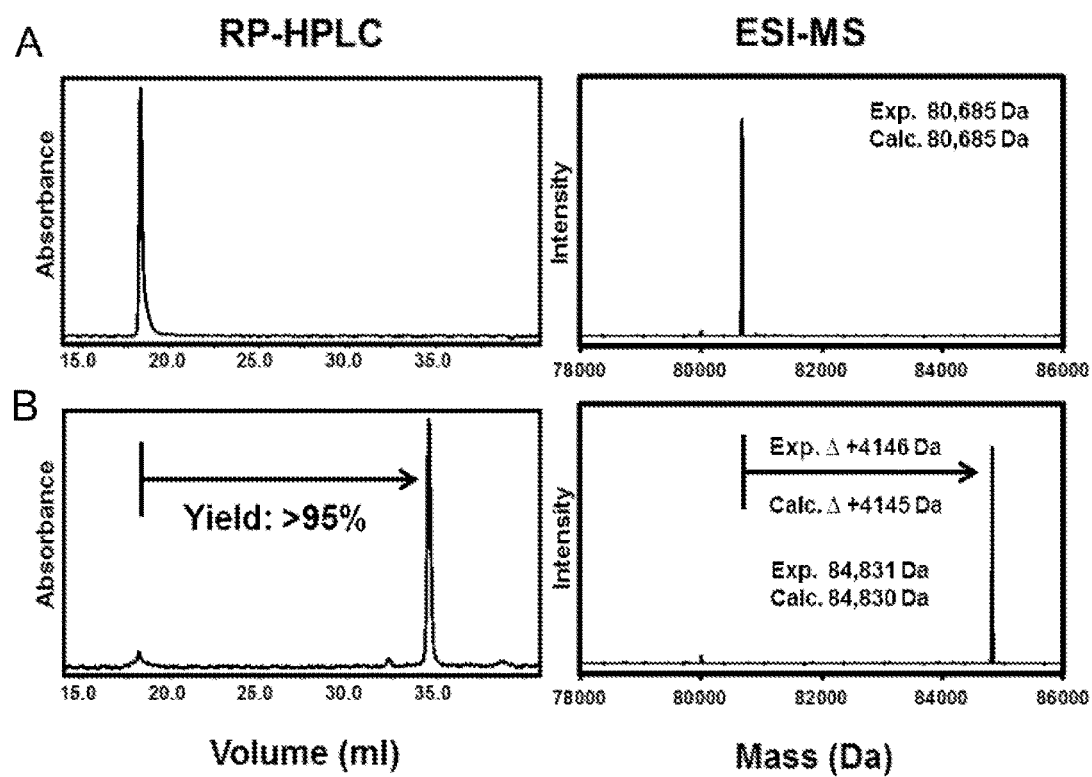
FIG. 69 shows preparation of GLP2-XTEN conjugate from GLP2-Mal peptide and 1×Thiol-XTEN as described in Example 27. 20 μg protein samples were loaded on Phenomenex Jupiter C18 5 uM 300 A 4.6 mm×150 mm column. Proteins were eluted with 5-50% gradient of acetonitrile in 0.1% trifluoroacetic acid and detected by absorbance at 214 nm (left panels A, B). 100 μg protein samples were desalted using NanoSep 3K Omega centrifugal devices (Pall Corp.). Protein solutions in 50% acetonitrile, 0.5% formic acid were infused into high-resolution mass spectrometer at flow rate 10 ul/min. ESI-MS spectra were acquired in 800-1600 amu range and reconstructed into zero-charge spectra using Bayesian Protein Reconstruction Software (right panels A, B).

1×Thiol-XTEN (XTEN_AE880(Am1,C8)(Seg 181) was prepared as 122 uM (9.84 mg/ml) solution in 20 mM HEPES, pH 7.0, 50 mM NaCl. GLP2-N-Maleimide peptide (CSBio, custom synthesis) was dissolved in DMSO to the final concentration 3 mg/ml. 1×Thiol-XTEN (8.8 mg in 900 µl) was mixed with 3-fold molar excess of GLP2-N-Mal peptide and incubated for 1 hr at 25° C. Completion of the modification and the resulting conjugate was monitored by C18 RP-HPLC (20 µg protein samples were loaded on Phenomenex Jupiter C18 5 uM 300 A 4.6 mm×150 mm column. Proteins were eluted with 5-50% gradient of acetonitrile in 0.1% trifluoroacetic acid and detected by absorbance at 214 nm) and electrospray ionization mass spectrometry (ESI-MS analysis of samples was performed on 100 g protein samples desalted using NanoSep 3K Omega centrifugal devices (Pall Corp.). Protein solutions in 50% acetonitrile, 0.5% formic acid were infused into high-resolution mass spectometer at flow rate 10 µl/min. Spectra were acquired in 800-1600 amu range and reconstructed into zero-charge spectra using Bayesian Protein Reconstruction Software.) The results of the analysis are shown in FIG. 69. The GLP2-XTEN conjugate was purified by preparative C4 RP-HPLC (Vydac Protein C4 5µ 300 A 10 mm×250 mm column) using 5-50% gradient of acetonitrile in 0.1% TFA as mobile phase (see FIG. 70A). Final HPLC-purified GLP2-XTEN conjugate was analyzed using Phenomenex Jupiter C18 5 uM 300 A 4.6 mm×150 mm column (see FIG. 70B). The field of purified GLP2-XTEN conjugate was 6.2 mg (70%).

Example 28: Conjugation of DBCO-Mal to 1×Thiol-XTEN

Figure 71:
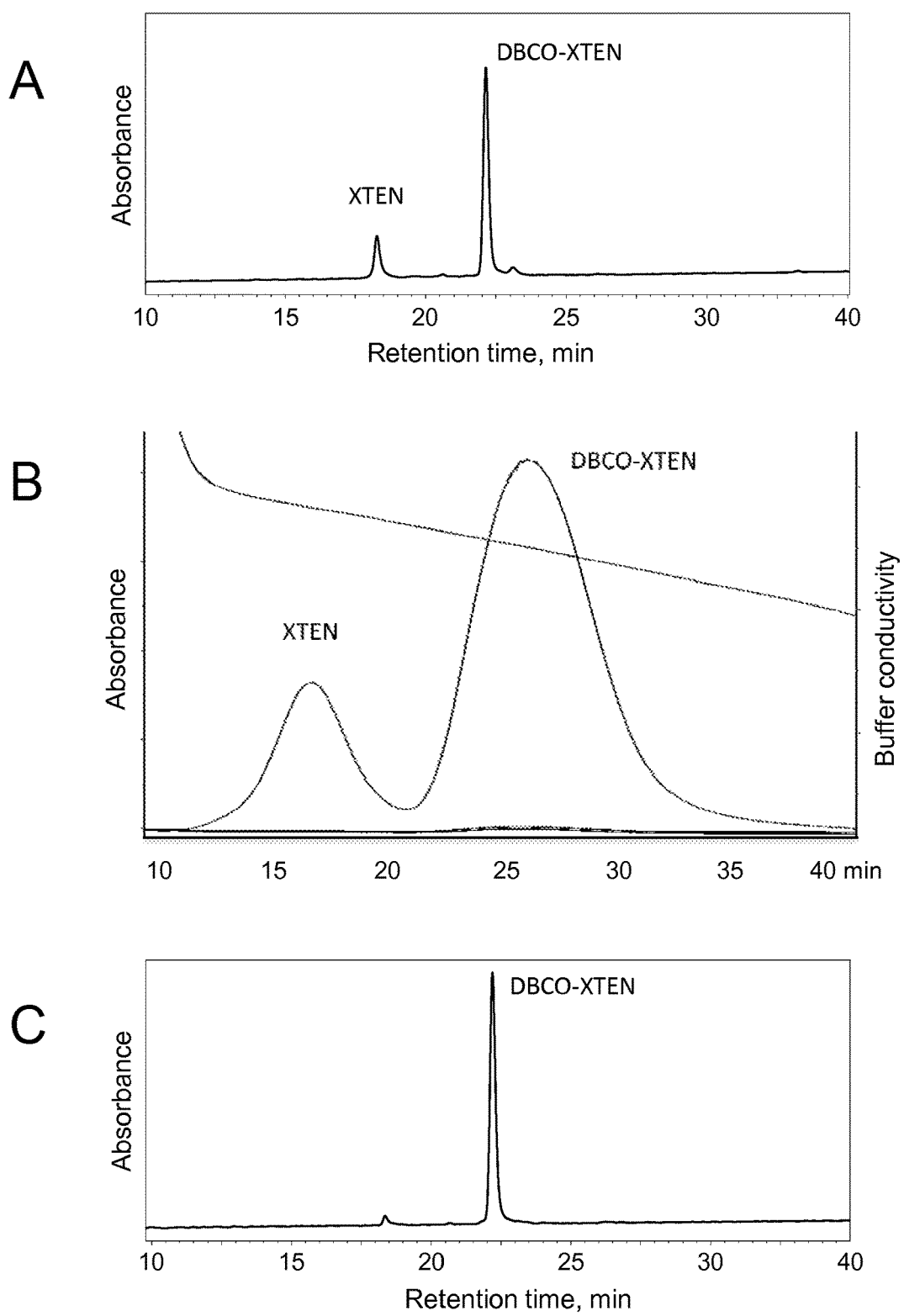
FIG. 71 shows results of the conjugation of DBCO-Mal to 1×Thiol-XTEN, as described in Example 28.

1×Thiol-XTEN (XTEN_AE880(Am1,C8) (Seg 181) was prepared as a 150 uM (12 mg/ml) solution in 20 mM HEPES, pH 7.0, 50 mM NaCl. DBCO-Maleimide (Click Chemistry Tools, Inc., cat. # A108) was dissolved in DMF to a final concentration of 50 mM. A volume of 200 ul (2.4 mg) 1×Thiol-XTEN was adjusted to 100 mM HEPES pH 7.0 using a 1M stock solution. A 1.2 µl volume of 50 mM DBCO-Mal in DMF was added to the protein solution (1:2 molar ratio of 1×Thiol-XTEN to DBCO-Maleimide reagent) and was incubated for 1 hr at 25° C. Completion of the modification reaction was monitored by C18 RP-HPLC (FIG. 71A). The protein mixture was purified by hydrophobic interaction chromatography (HIC) using a 1.6 ml Toyopearl Butyl column. Elution was performed with a 30 column volume of a descending gradient of ammonium sulfate from 1.05 M to 0.3M in 20 mM Phosphate, pH 7.0 buffer at 0.5 ml/min flow rate (FIG. 71B). Chromatographic fractions were analyzed by C18 RP-HPLC (FIG. 71C).

Example 29: Preparation of a Bispecific Conjugate from Monospecific XTEN Precursors Linked by the N-Termini The example describes the creation of an XTEN-payload composition by linking two different XTEN-payload precursors in an N- to N-terminus configuration; one with a payload A and one with a payload B, resulting in a bispecific conjugate.

As a first step, XTEN molecules containing multiple cysteines (cysteine-engineered XTEN) are prepared using a RP11-His8 ("His8" disclosed as SEQ ID NO: 20) two-tag purification system, described above, and are formulated in 20 mM HEPES, pH 7.0, 50 mM NaCl. A Payload A-maleimide is dissolved in aqueous solution 20 mM HEPES, pH 7.0, DMF or DMCO or any other appropriate solvent depending on reagent solubility. The Payload A-maleimide is added to the cysteine-engineered XTEN in a 2-6 molar excess over XTEN and incubated for 1 hr at 25° C. Completion of modification is monitored by C18 RP-HPLC. The resulting Payload A-XTEN conjugate is purified from contaminants and unreacted components using preparative C4-C18 RP-HPLC. The Payload A-XTEN conjugate is formulated in 20 mM HEPES, pH 7.0, 50 mM NaCl. Next, the Payload A-XTEN conjugate is further modified by adding dibenzylcyclooctyne (DBCO)-NHS ester or DBCO-sulfo-NHS ester in a 10-50 molar excess to the XTEN and incubating 1-2 hrs at 25° C. Completion of the modification is monitored by analytical C18 RP-HPLC. If the conjugation efficiency is low (for example, <90%) or multiple unspecific products are formed, the DBCO-Payload A-XTEN conjugate is purified using preparative C4-C18 RP-HPLC. If the efficiency of DBCO-NHS ester conjugation is high (>90%) with no significant side products, the DBCO-Payload A-XTEN conjugate is purified from excess reagent by buffer exchange using a 10-30 kDa MWCO centrifugal device, acetonitrile precipitation or anion exchange chromatography.

To create the second XTEN-payload precursor, a Payload B-maleimide is dissolved in aqueous solution 20 mM HEPES, pH 7.0, DMF or DMCO or any other appropriate solvent depending on reagent solubility. Payload B-maleimide is added to the second cysteine-containing XTEN in 2-6 molar excess over XTEN concentration and incubated for 1 hr at 25° C. Completion of modification is monitored by analytical C18 RP-HPLC. The resulting Payload B-XTEN conjugate is purified from contaminants and reactants using preparative C4-C18 RP-HPLC. The Payload B-XTEN conjugate is formulated in 20 mM HEPES, pH 7.0, 50 mM NaCl. Azide-PEG4-NHS ester is added in 10-50 molar excess to the Payload B-XTEN and incubated 1-2 hrs at 25° C. Completion of modification is monitored by C18 RP-HPLC. If the conjugation efficiency is low (for example <90%) or multiple unspecific products are formed, the azide-Payload B-XTEN conjugate is purified using preparative C4-C18 RP-HPLC. If the efficiency of DBCO-NHS ester conjugation is high (>90%) with no significant side products, the azide-Payload B-XTEN conjugate is purified from excess reagent by buffer exchange using a 10-30 kDa MWCO centrifugal device, acetonitrile precipitation or anion exchange chromatography. The final product is created by mixing purified and concentrated DBCO-Payload A-XTEN and azide-Payload B-XTEN proteins in an equilmolar ratio in 20 mM HEPES pH 7.0 buffer, 50 mM NaCl and incubated at 25° C. for 1 hr or longer until the reaction is complete. Completion of modification is monitored by C4 or C18 RP-HPLC. If necessary, the bispecific conjugate Payload A-XTEN-Payload B is purified by preparative RP-HPLC, hydrophobic interaction chromatography or anion exchange chromatography.

Example 30: Preparation of a Trimeric Conjugate from Monospecific XTEN Precursors Linked by the N-Termini Monospecific XTEN-payload precursors will be prepared as N-terminal fusions of a Payload A linked to an XTEN molecule; e.g. of lengths ranging from AE144 to AE890, containing a single cysteine at the C-terminus (prepared and purified as described in Example 25). Purified precursors are formulated in 20 mM HEPES, pH 7.0, 50 mM NaCl. Tris-(2-maleimidoethyl)amine (TMEA, Thermo Scientific, cat. #33043) and dissolved in DMSO or DMF. Precursor (4-6 molar excess over cross-linker) and TMEA reagent are mixed and incubated for 1 hr at 25° C. Completion of the modification is monitored by C4 or C18 RP-HPLC or size exclusion chromatography. The resulting trivalent Payload A-XTEN conjugate is purified from protein reactants or partial product mixture by hydrophobic interaction chromatography (HIC), anion exchange chromatography or preparative C4-C18 RP-HPLC.

Example 31: Conjugation and Purification of FITC-X-XTEN

Purified protein derived from AC272, lot # AP197, was labeled with FITC maleimide. The sample was reduced by incubating at room temperature with 5 mM TCEP for 1 hour. The sample was then desalted into PBS using DG-10 columns. The sample was labeled by adding a 25-fold molar excess of FITC-maleimide in DMSO and incubating at room temperature for 2 hours. Note that the volume adjusted such that the DMSO concentration was <5% of total solvent. The reaction was quenched by adding 2 mM DTT and then the sample was digested overnight with TEV protease. The sample was diluted two fold with 20 mM Tris pH 7.5 and loaded onto a macrocapQ column, previously sanitized with NaOH and equilibrated with 20 mM Tris pH 7.5. The column was washed with 5 column volumes of 20 mM Tris pH 7.5, 135 mM NaCl, 5 column volumes of 20 mM Tris pH 7.5, 175 mM NaCl and eluted with 5 column volumes of 20 mM Tris pH 7.5, 250 mM NaCl. The pooled elution fractions were then digested with TEV over 60 hours at 4 C to complete the digestion. The digested samples were then twice passed over a 1 ml perloza column previously sanitized with NaOH and equilibrated with 20 mM Tris pH 7.5, 135 mM NaCl. To remove any free FITC the sample was then dialyzed against 20 mM Tris pH 7.5, 135 mM NaCl using a 10,000 MWCO membrane. Co-migration of the OD214 protein signal and OD495 FITC signal in a SEC column indicate successful conjugation of the XTEN with the label, with minimal free dye contamination (FIG. 72B). The successful conjugation is also indicated by apparent large MW of the protein with FITC fluorescence in SDS PAGE (FIG. 72A).

Example 32: Purification of GFP-X-XTEN

Figure 73:
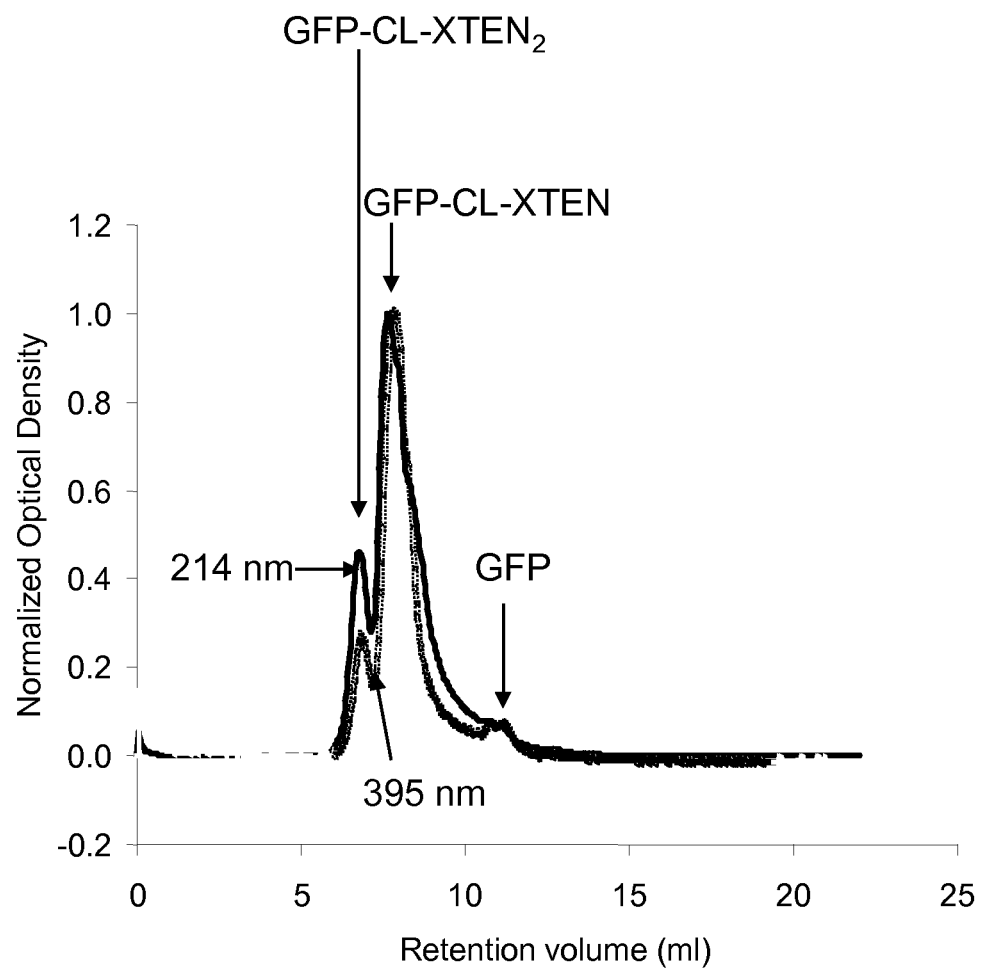
FIG. 73 shows results of SEC analyses of the peak elution fractions of conjugates of GFP cross-linked to XTEN and free GFP, as described in Example 32. Cross-linking was confirmed by co-migration of the OD214 protein signal and OD395 GFP signal in the SEC column.

GFP (AC219) was chemically cross-linked to XTEN by a bifunctional cross-linker with an amine reactive group to couple to the GFP lysines and a cysteine reactive group to couple to the free cysteine engineered into the XTEN in AC292. GFP was labeled with bi-functional cross-linker sulfo-SMCC by incubating at room temperature for 2 hours. The protein was desalted into PBS using DG-10 columns to remove free sulfo-SMCC. Purified protein derived from AC272, lot # AP197 was reduced and desalted into PBS on DG-10 columns and mixed with the labeled GFP to allow for cross-linking. The cross-linking reaction was quenched with 2 mM DTT and TEV added to remove the CBD domain in a overnight incubation at 4° C. The following day additional TEV was added to complete the digestion with an additional 60 hour 4° C. incubation. Following TEV digestion the sample was dilute to 100 ml in 20 mM Tris pH 7.5 and loaded onto a macrocapQ column, previously sanitized with NaOH and equilibrated with 20 mM Tris pH 7.5. The column was washed with 5 column volumes of 20 mM Tris pH 7.5, 5 column volumes of 20 mM Tris pH 7.5, 50 mM NaCl, 5 column volumes of 20 mM Tris pH 7.5, 100 mM NaCl, 5 column volumes of 20 mM Tris pH 7.5, 150 mM NaCl, 5 column volumes of 20 mM Tris pH 7.5, 200 mM NaCl, 5 column volumes of 20 mM Tris pH 7.5, 250 mM NaCl, 5 column volumes of 20 mM Tris pH 7.5, 300 mM NaCl, and 5 column volumes of 20 mM Tris pH 7.5, 500 mM NaCl. The peak elution fractions were pooled and stored at 4° C. Cross-linking was confirm by co-migration of the OD214 protein signal and OD395 GFP signal in a SEC column, with the SEC output shown as overlays in FIG. 73.

Example 33: Pharmacokinetics of GFP-XTEN and FITC-XTEN Conjugates

Figure 74:
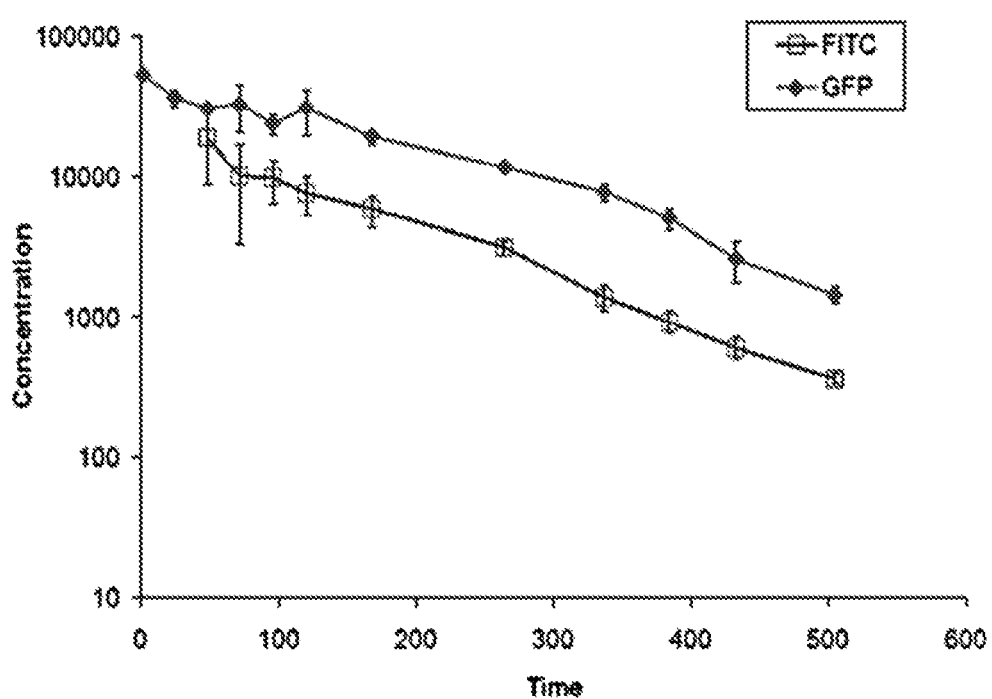
FIG. 74 shows the results of pharmacokinetic assays of GFP-X-XTEN and FITC-X-XTEN tested in cynomolgus monkeys, as described in Example 33.

The pharmacokinetics of the GFP-XTEN and FITC-XTEN cross-linked conjugates prepared as described in the Examples above were tested in cynomolgus monkeys. GFP-XTEN and FITC-XTEN were administered to male cynos IV at 2 mg/kg and dose volumes of 0.77 and 0.68 mL respectively. Blood samples (1.0 mL) were collected into prechilled heparinized tubes at predose, 2, 4, 8, 24, 48, 72, 96, 120, 168, 216, 264, 336, 388, 432, 504 hour time points, and processed into plasma. Quantitation was performed by ELISA assay using the anti-XTEN antibody for both capture and detection in the case of GFP-XTEN and anti-XTEN capture and anti-FITC detection in the case of FITC-XTEN. A non-compartmental analysis was performed in WinNon-Lin with all time points included in the fit to determine the PK parameters. The pharmacokinetic results are summarized in Table 40 and FIG. 74. The data show XTEN can extend the half-life of molecules to which it is chemically conjugated in a manner comparable to genetic fusions to payloads of similar size.

TABLE 40

PK parameters of conjugated XTEN-payload compositions.

| Construct | Cmax (ng/mL) | AUC (hr*ng/mL) | T ½ (hrs) |
| --- | --- | --- | --- |
| GFP-X-XTEN (AP197d) | 52800 | 8220000 | 107 |
| FITC-X-XTEN AP197e | 18900 | 3930000 | 84.2 |

Figure 75:
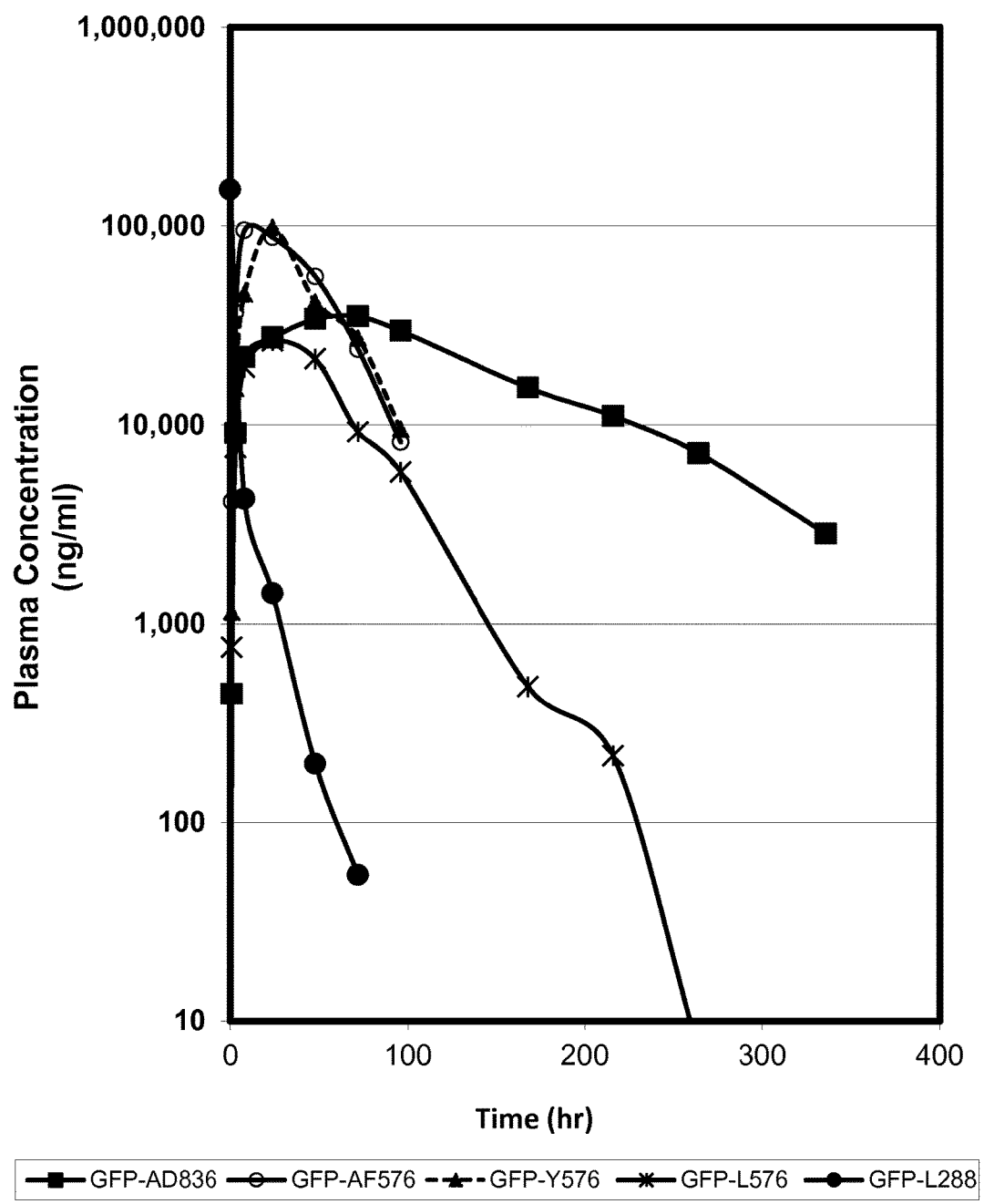
FIG. 75 shows the pharmacokinetic profile (plasma concentrations) in cynomolgus monkeys after single doses of different compositions of GFP linked to unstructured polypeptides of varying length, administered either subcutaneously or intravenously, as described in Example 33. The compositions were GFP-L288, GFP-L576, GFP- XTEN_AF576, GFP-Y576 and XTEN_AD836-GFP. Blood samples were analyzed at various times after injection and the concentration of GFP in plasma was measured by ELISA using a polyclonal antibody against GFP for capture and a biotinylated preparation of the same polyclonal antibody for detection. Results are presented as the plasma concentration versus time (h) after dosing and show, in particular, a considerable increase in half-life for the XTEN_AD836-GFP, the composition with the longest sequence length of XTEN. The construct with the shortest sequence length, the GFP-L288 had the shortest half-life.

The pharmacokinetics of GFP-L288, GFP-L576, GFP-XTEN_AF576, GFP-XTEN_Y576 and XTEN_AD836-GFP were tested in cynomolgus monkeys to determine the effect of composition and length of the unstructured polypeptides on PK parameters. Blood samples were analyzed at various times after injection and the concentration of GFP in plasma was measured by ELISA using a polyclonal antibody against GFP for capture and a biotinylated preparation of the same polyclonal antibody for detection. Results are summarized in FIG. 75. They show a surprising increase of half-life with increasing length of the XTEN sequence. For example, a half-life of 10 h was determined for GFP-XTEN_L288 (with 288 amino acid residues in the XTEN). Doubling the length of the unstructured polypeptide fusion partner to 576 amino acids increased the half-life to 20-22 h for multiple fusion protein constructs; i.e., GFP-XTEN_L576, GFP-XTEN_AF576, GFP-XTEN_Y576. A further increase of the unstructured polypeptide fusion partner length to 836 residues resulted in a half-life of 72-75 h for XTEN_AD836-GFP. Thus, increasing the polymer length by 288 residues from 288 to 576 residues increased in vivo half-life by about 10 h. However, increasing the polypeptide length by 260 residues from 576 residues to 836 residues increased half-life by more than 50 h. These results show that there is a surprising threshold of unstructured polypeptide length that results in a greater than proportional gain in in vivo half-life. Thus, fusion proteins comprising extended, unstructured polypeptides are expected to have the property of enhanced pharmacokinetics compared to polypeptides of shorter lengths.

Example 34: Preparation of 1×DBCO,3×LHRH-XTEN by Conjugation

Figure 88:
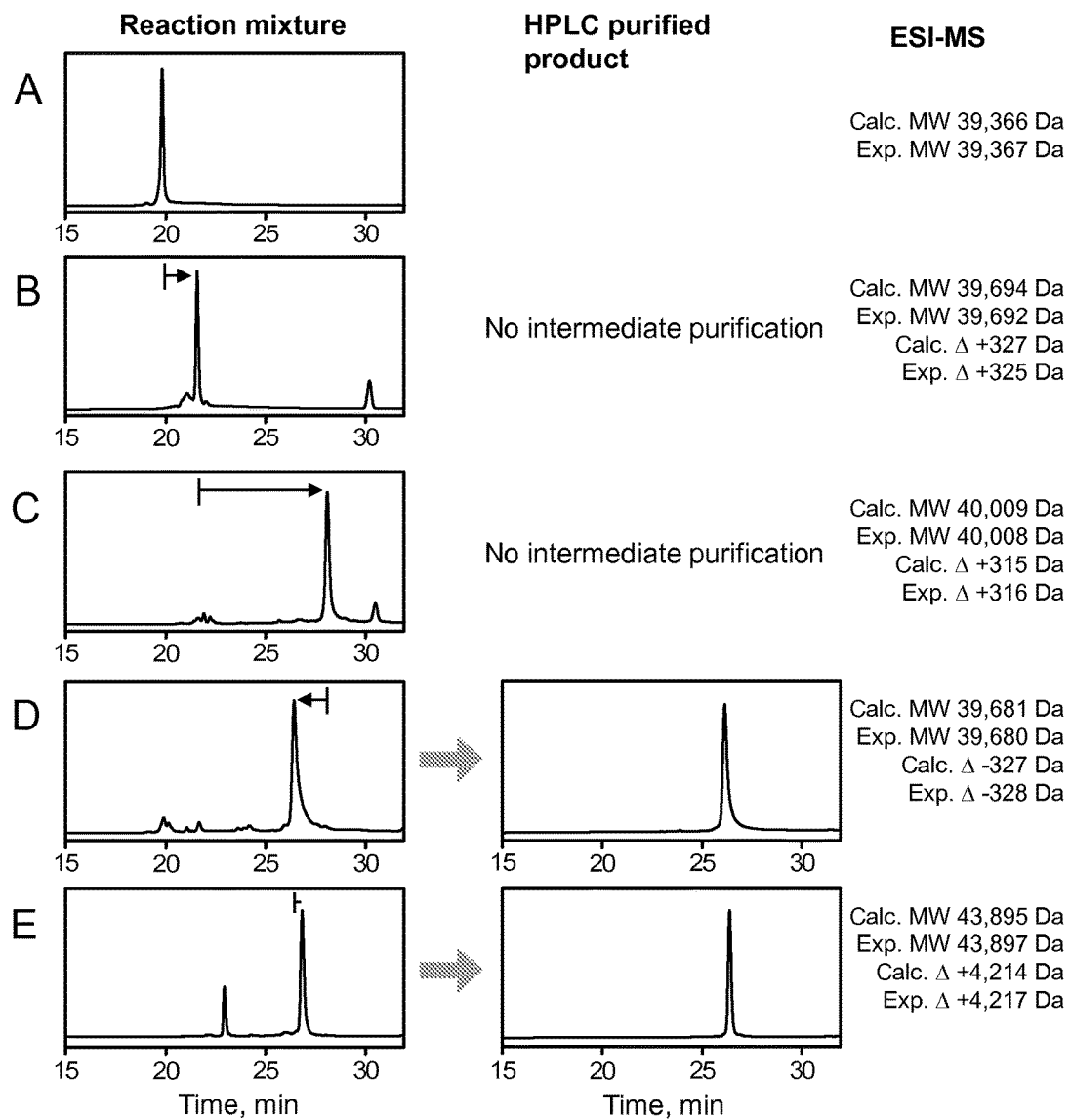
FIG. 88 shows results from the analyses of intermediates and final product during the preparation of 1×DBCO,3×LHRH-XTEN, as described in Example 34.

An aliquot of 1×Amino,3×Thiol-XTEN432 (XTEN_AE432(Am1,C12,C217,C422)) was prepared as a 196 µM (7.7 mg/ml) solution in 20 mM HEPES, pH 7.0, 50 mM NaCl. FIG. 88A shows a C18 RP-HPLC and ESI-MS analysis of the protein. 2,2'-Dipyridyl disulfide (DPD, Sigma, cat. # D5767) was dissolved in dimethylformamide (DMF) to the final concentration 100 mM. 4 ml of 1×Amino, 3×Thiol-XTEN432 solution was mixed with 0.2 ml 1 M HEPES, pH 8.0 to adjust the pH to ~7.5 and with 78 µl DPD solution (10× molar excess over protein). The reaction mixture was incubated for 2 hours at 25° C. and products of the reaction were analyzed by C18 RP-HPLC (FIG. 88B). DBCO-sulfo-NHS (Click Chemistry Tools, Inc., cat. # A124) was dissolved in anhydrous DMF to a final concentration of 10 mM. 0.865 ml of DBCO-sulfo-NHS solution was added to protein solution (1× molar excess over protein). The reaction mixture was incubated for 2 hours at 25° C. and products of reaction were analyzed by C18 RP-HPLC (FIG. 88C). A solution of 1M ethanolamine pH 8.0 was added to a final concentration of 50 mM to quench the unreacted DBCO-sulfo-NHS. The reaction mixture was incubated for 2 hours at 25° C. and then overnight at 4° C. 500 mM Bond-Breaker™ TCEP Solution (Thermo Scientific, cat. #77720) was added to a final concentration 20 mM. The reaction mixture was incubated for 1 hour at 25° C. and the products of reaction were analyzed by C18 RP-HPLC (FIG. 88D). The reaction mixture was diluted to 15 mL with 0.01% TFA and pH adjusted to ~3 using 10% TFA solution. The protein solution was loaded on a preparative C4 RP-HPLC column Vydac C4 250×22 mm (Grace Davison Discovery Sciences, cat. #214TP1022). The protein was eluted with 1200 ml linear 5-50% gradient of acetonitrile in 0.01% TFA at 15 ml/min flow rate. Fractions containing 1×DBCO,3×Thiol-XTEN432 were adjusted to pH~7 with 1 M HEPES pH 8 and were concentrated by vacuum evaporation. A Glp-His-Trp-Ser-Tyr-D-Lys-Leu-Arg-Pro-Gly-NH2 (SEQ ID NO: 1102) peptide modified with 3-maleimidopropionic acid at ε-amino group of D-Lys (LHRH-Mal) was synthesized by CSBio Co. (Menlo Park, Calif.). The peptide was dissolved to a final concentration 25 mg/ml in anhydrous DMF and was added to 1×DBCO,3×Thiol-XTEN432 solution in a 5× molar excess over protein. The reaction mixture was incubated for 1 hr at 25° C. and the products of the reaction were analyzed by C18 RP-HPLC (FIG. 88E). The reaction mixture was diluted to 15 mL with 0.01% TFA and the pH adjusted to ~3 using a 10% TFA solution. The protein solution was loaded on preparative C4 RP-HPLC column Vydac C4 250×22 mm. The protein was eluted with 1200 ml linear 5-50% gradient of acetonitrile in 0.01% TFA at 15 ml/min flow rate. Fractions containing 1×DBCO,3×LHRH-XTEN432 were adjusted to ~pH 7 with 1 M HEPES pH 8 and concentrated to 2 ml by vacuum evaporation to yield the final product.

Example 35: Preparation of 1×Azide,3×MMAE-XTEN by Conjugation

Figure 89:
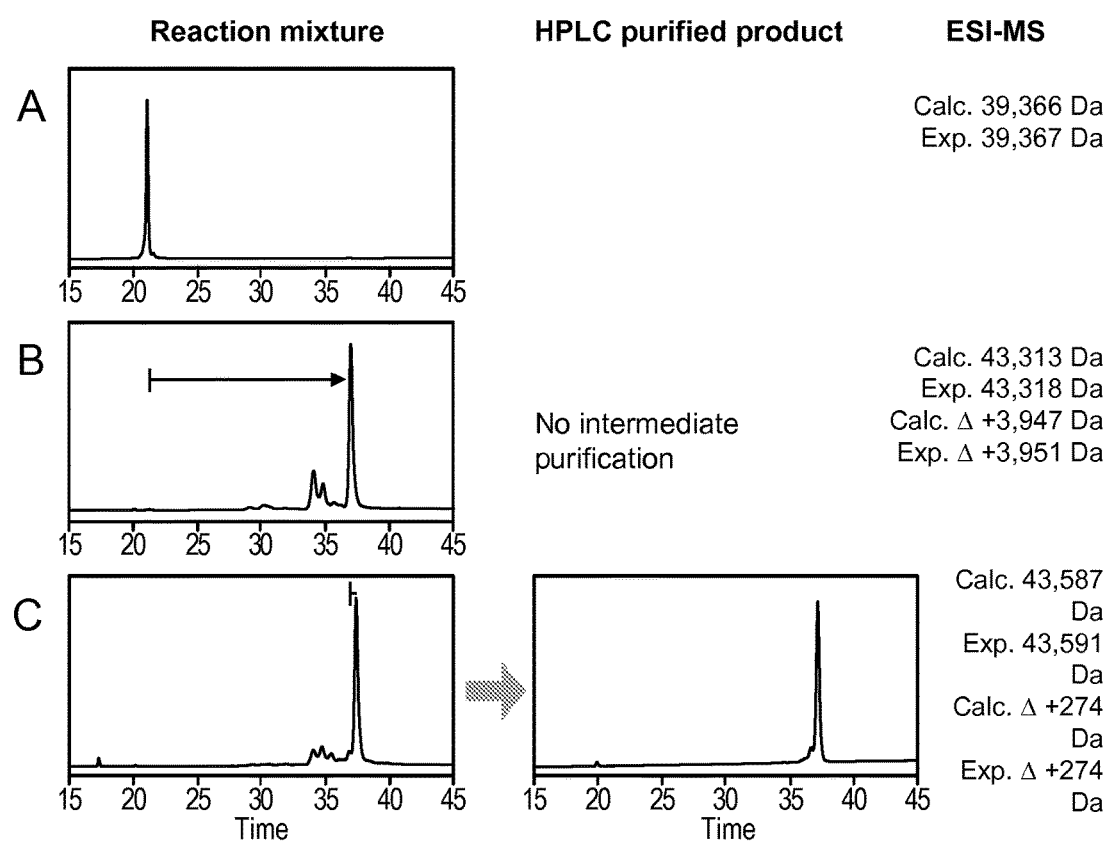
FIG. 89 shows results of analyses of reaction mixtures from the preparation of conjugates to 1×Azide,3×MMAE-XTEN analyzed by C18-RP-HPLC and mass spectroscopy, as described in Example 35.

An aliquot of the fusion protein 1×Amino,3×Thiol-XTEN432 (XTEN_AE432(Am1,C12,C217,C422)) was prepared as 196 µM (7.7 mg/ml) solution in 20 mM HEPES, pH 7.0, 50 mM NaCl. FIG. 89A shows a C18 RP-HPLC and ESI-MS analysis of the protein. MA6-Val-Cit-PAB-MMAE (MMAE-Mal, custom synthesis by Concortis Biosystems, Inc.) was dissolved in dimethylsulfoxide (DMSO) to a final concentration 1 mg/ml. A 2.2 ml volume of 1×Amino,3×Thiol-XTEN432 solution was mixed with 2.5 ml of MMAE-Mal (3.5× molar excess over protein). The reaction mixture was incubated for 1 hr at 25° C. and the products of the reaction were analyzed by C18 RP-HPLC (FIG. 89B). Azide-PEG4-NHS ester (Click Chemistry Tools, Inc., cat. # A103) was dissolved in anhydrous DMF to a final concentration of 500 mM. The reaction mixture (4.7 ml) was mixed with 0.235 ml 1 M HEPES, pH 8.0 and with 9.75 ul 500 mM azide-PEG4-NHS (10× molar excess over protein). The reaction mixture was incubated for 2 hr at 25° C. and the products of reaction were analyzed by C18 RP-HPLC (FIG. 89C). The conjugation mixture was diluted to 15 ml with 0.01% TFA and the pH was adjusted to ~3 using 10% TFA. The protein solution was loaded onto a preparative C4 RP-HPLC column Vydac C4 250×22 mm (Grace Davison Discovery Sciences, cat. #214TP1022). The protein was eluted with 1200 ml linear 5-50% gradient of acetonitrile in 0.01% TFA at 15 ml/min flow rate. Fractions containing 1×Azide,3×MMAE-XTEN432 were adjusted to ~pH7 with 1 M HEPES pH 8 and concentrated by vacuum evaporation to yield the final product.

Example 36: Preparation of 3×LHRH,3×MMAE-XTEN by Conjugation

Figure 90:
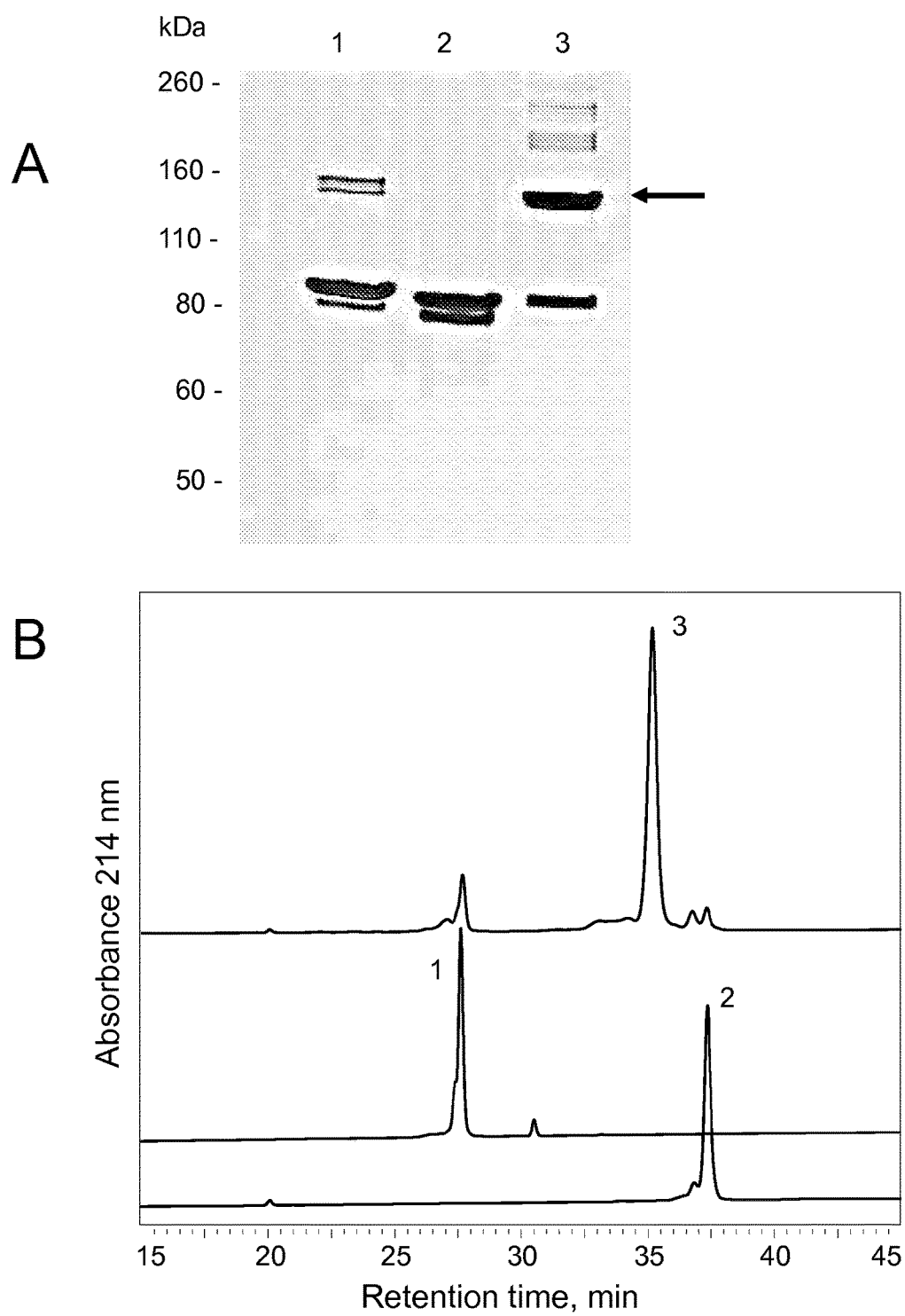
FIG. 90 shows analyses of the reaction products in conjugates of 3×LHRH,3×MMAE-XTEN as described in Example 36.

An aliquot of the fusion protein 1×DBCO,3×LHRH-XTEN432 was prepared as 143 µM (6.26 mg/ml) solution in 20 mM HEPES, pH 7.0. 1×Azide,3×MMAE-XTEN432 was prepared as a 135 µM (5.90 mg/ml) solution in 20 mM HEPES, pH 7.0. The two protein reactants were mixed in solution to yield a 1.1 molar excess of 1×DBCO,3×LHRH-XTEN432. The reaction mixture was incubated overnight at 25° C. Completion of the click chemistry reaction was analyzed by SDS-PAGE (FIG. 90A) and RP-HPLC (FIG. 90B). The conjugation mixture was diluted to 15 ml with 0.01% TFA and pH adjusted to ~3 using 10% TFA. The protein solution was loaded onto a preparative C4 RP-HPLC column Vydac C4 250×10 mm (Grace Davison Discovery Sciences, cat. #214TP510). The protein was eluted with 180 ml linear 5-50% gradient of acetonitrile in 0.01% TFA at 2 ml/min flow rate. Fractions containing 3×LHRH,3×MMAE-XTEN were adjusted to ~pH7 with 1 M HEPES pH 8 and concentrated by vacuum evaporation to yield the final product.

Example 37: Preparation of 1×LHRH,3×MMAE-XTEN by Conjugation

Figure 91:
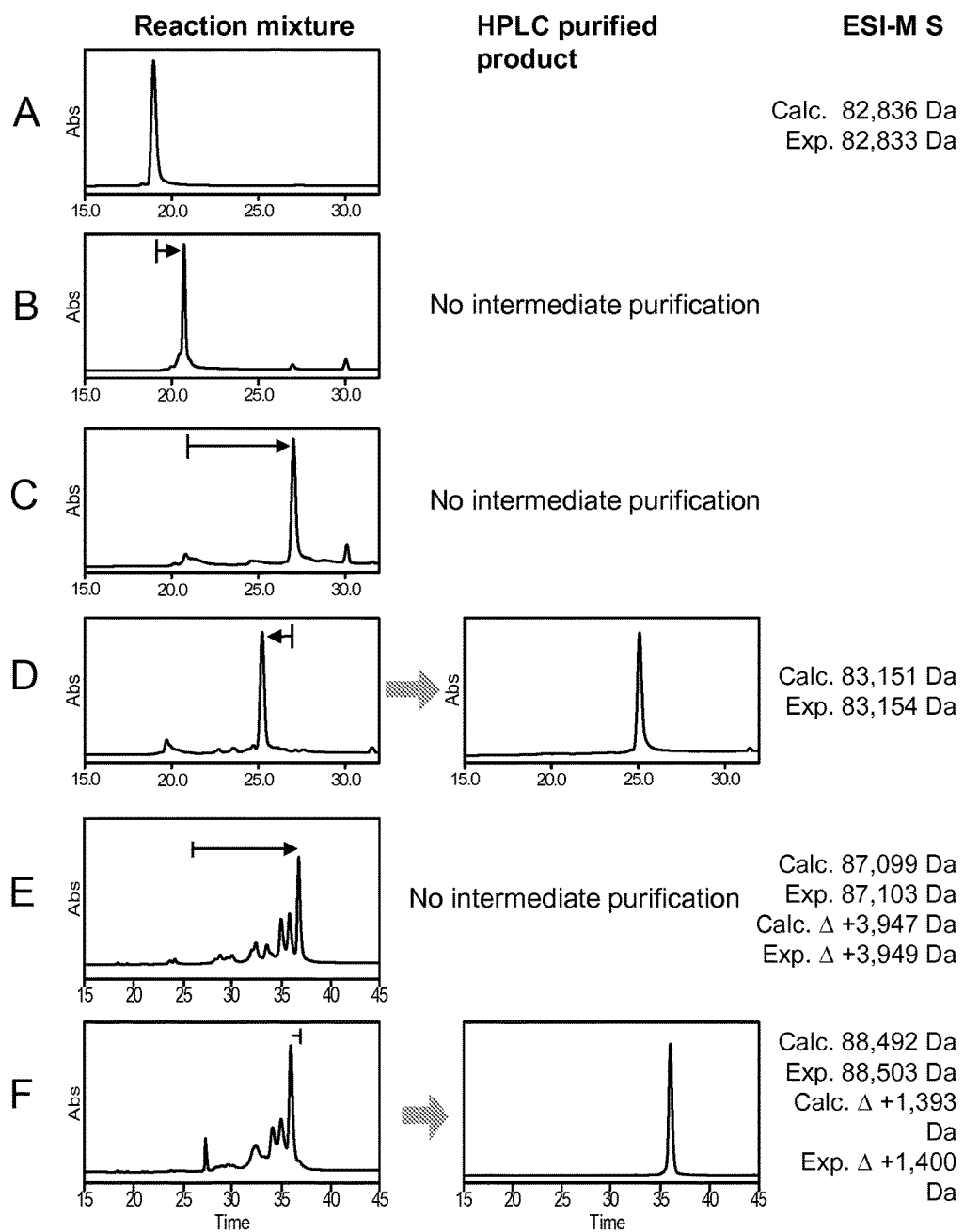
FIG. 91 shows a flow chart of the reaction during preparation of conjugates of 1×LHRH,3×MMAE-XTEN, as described in Example 37.

An aliquot of the fusion protein 1×Amino,3×Thiol-XTEN905 (XTEN_AE905(Am1,C8,C453,C898, Seg 174)) was prepared as a 131 µM (10.9 mg/ml) solution in 20 mM HEPES, pH 7.0, 50 mM NaCl. FIG. 91A shows a C18 RP-HPLC and ESI-MS analysis of the protein. 2,2'-Dipyridyl disulfide (DPD, Sigma, cat. # D5767) was dissolved in dimethylformamide (DMF) to the final concentration 100 mM. The 1×Amino,3×Thiol-XTEN905 solution was adjusted pH to ~7.5 using 1 M HEPES pH 8 and mixed with DPD solution (10× molar excess over protein). The reaction mixture was incubated for 2 hr at 25° C. and the products of the reaction were analyzed by C18 RP-HPLC (FIG. 91B). DBCO-sulfo-NHS (Click Chemistry Tools, Inc., cat. # A124) was dissolved in anhydrous DMF to a final concentration 10 mM. DBCO-sulfo-NHS solution was added to the protein solution (10× molar excess over protein). The reaction mixture was incubated for 2 hr at 25° C. and the products of the reaction analyzed by C18 RP-HPLC (FIG. 91C). 1M ethanolamine pH 8.0 was added to a final concentration of 50 mM to quench unreacted DBCO-sulfo-NHS. The reaction mixture was incubated for 2 hr at 25° C. and then overnight at 4° C. A 500 mM Bond-Breaker™ TCEP Solution (Thermo Scientific, cat. #77720) was added to a final concentration 20 mM. The reaction mixture was incubated for 1 hour at 25° C. and the products of the reaction were analyzed by C18 RP-HPLC (FIG. 91D). The reaction mixture was diluted to 15 mL with 0.01% TFA and the pH adjusted to ~3 using 10% TFA solution. The protein solution was loaded onto preparative C4 RP-HPLC column Vydac C4 250×22 mm (Grace Davison Discovery Sciences, cat. #214TP1022). The protein was eluted with 1200 ml linear 5-50% gradient of acetonitrile in 0.01% TFA at 15 ml/min flow rate. Fractions containing 1×DBCO,3×Thiol-XTEN905 were adjusted to ~pH7 with 1 M HEPES pH 8 and concentrated by vacuum evaporation. MA6-Val-Cit-PAB-MMAE (MMAE-Mal, custom synthesis by Concortis Biosystems, Inc.) was dissolved in dimethylsulfoxide (DMSO) to a final concentration 1 mg/ml. 1×DBCO,3×Thiol-XTEN905 solution was mixed with a 3.5× molar excess of MMAE-Mal. The reaction mixture was incubated for 1 hr at 25° C. and products of the reaction were analyzed by C18 RP-HPLC. The Glp-His-Trp-Ser-Tyr-D-Lys-Leu-Arg-Pro-Gly-NH2 (SEQ ID NO: 1102) peptide was modified with azido-hexanoic acid at the ε-amino group of D-Lys (LHRH-Mal, custom synthesis by CS Bio Co., Menlo Park, Calif.). The peptide was dissolved to a final concentration 25 mg/ml in anhydrous DMF and added to 1×DBCO,3×MMAE-XTEN905 solution in 1.5-5× molar excess over protein. The reaction mixture was incubated at 25° C. and the products of the reaction were analyzed by C18 RP-HPLC. The final reaction mixture was diluted to 15 mL with 0.01% TFA and pH adjusted to ~3 using 10% TFA solution. The protein solution was loaded on preparative C4 RP-HPLC column Vydac C4 250×22 mm. The protein was eluted with 1200 ml linear 5-50% gradient of acetonitrile in 0.01% TFA at 15 ml/min flow rate. Fractions containing 1×DBCO,3×LHRH-XTEN432 were adjusted to ~pH7 with 1 M HEPES pH 8 and concentrated by vacuum evaporation to yield the final product.

Example 38: Preparation of 1×DBCO,3×Folate(γ)-XTEN by Conjugation

Figure 107:
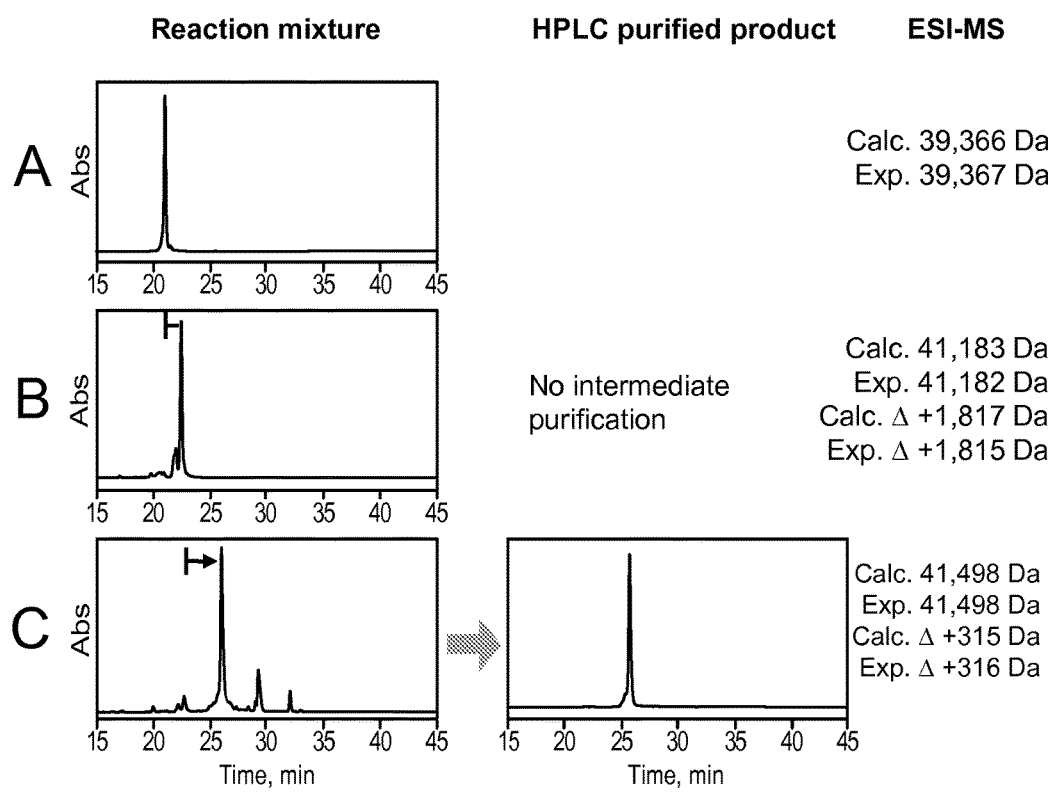
FIG. 107 shows results of analyses of reaction mixtures from the preparation of conjugates to 1×DBCO,3×FA(γ)-XTEN analyzed by C18-RP-HPLC and mass spectroscopy, as described in Example 38.

An aliquot of the fusion protein 1×Amino,3×Thiol-XTEN432 (XTEN_AE432(Am1,C12,C217,C422)) was prepared as a 203 µM (8.0 mg/ml) solution in 20 mM HEPES, pH 7.0, 50 mM NaCl. FIG. 107A shows a C18 RP-HPLC and ESI-MS analysis of the protein. Folate-γ-aminopentyl-maleimide (FA(γ)-Mal, custom synthesis by CPC Scientific) was dissolved in dimethylformamide (DMF) to a final concentration 21 mg/ml (9.8 mM). A 1.1 ml volume of 1×Amino,3×Thiol-XTEN432 solution was mixed with 0.08 ml of FA(γ)-Mal (3.5 molar excess over protein). The reaction mixture was incubated for 2 hrs at 25° C. and the products of the reaction were analyzed by C18 RP-HPLC (FIG. 107B). pH of the reaction mixture was adjusted with 0.06 ml of 1 M HEPES pH 8.0 buffer. DBCO-sulfo-NHS (Click Chemistry Tools, Inc., cat. # A124) was dissolved in anhydrous DMF to a final concentration of 50 mM. 0.53 ml of DBCO-sulfo-NHS solution was added to protein solution (11× molar excess over protein). The reaction mixture was incubated for 2 hours at 25° C. and products of reaction were analyzed by C18 RP-HPLC (FIG. 107C). A solution of 1M ethanolamine pH 8.0 was added to a final concentration of 50 mM to quench the unreacted DBCO-sulfo-NHS. The reaction mixture was incubated for 2 hours at 25° C. and then overnight at 4° C. The reaction mixture was diluted to 15 mL with 0.01% TFA and pH adjusted to ~3 using 10% TFA solution. The protein solution was loaded on a preparative C4 RP-HPLC column Vydac C4 250×10 mm (Grace Davison Discovery Sciences, cat. #214TP510). The protein was eluted with 180 ml linear 5-50% gradient of acetonitrile in 0.01% TFA at 2 ml/min flow rate. Fractions containing 1×DBCO,3×FA(7)-XTEN432 were adjusted to pH~7 with 1 M HEPES pH 8 and were concentrated by vacuum evaporation to yield the final product.

The 1×DBCO,3×Folate(α)-XTEN conjugate was prepared essentially as described above using folate-alpha-Maleimide (FA(α)-Mal, custom synthesis by CPC Scientific).

Example 39: Preparation of 3×FA(γ),3×MMAE-XTEN by Conjugation

Figure 108:
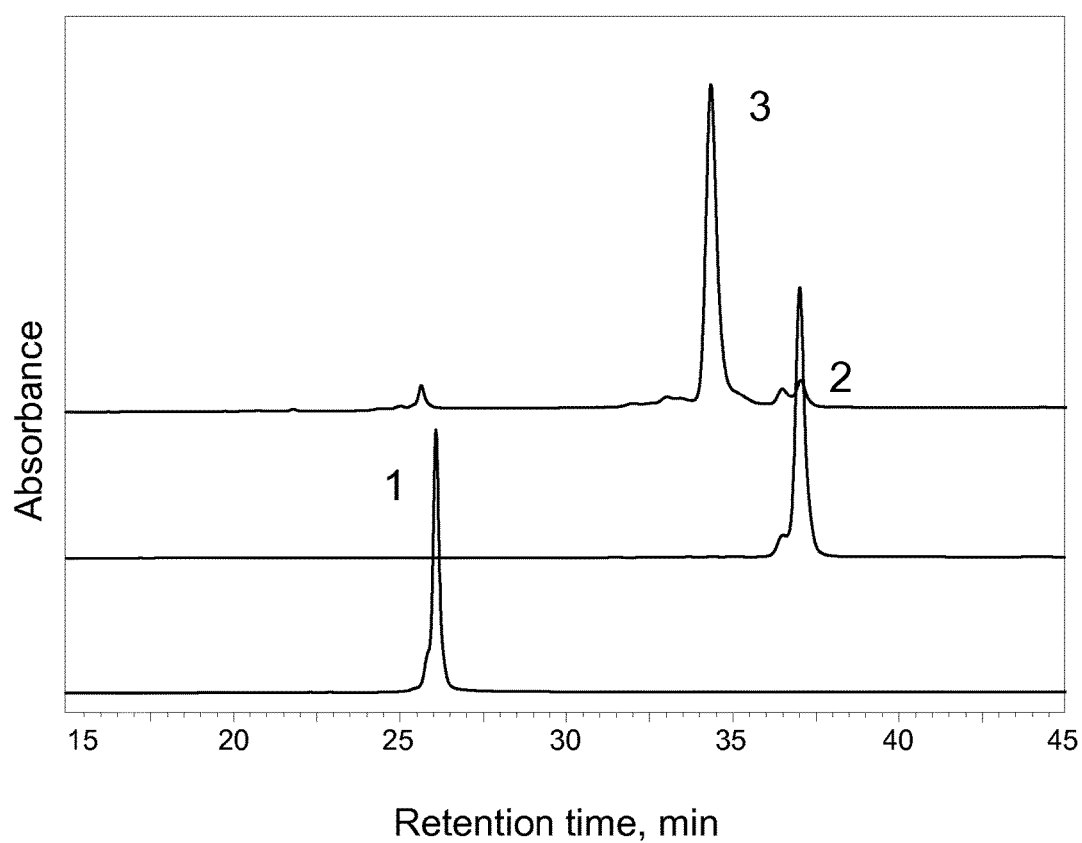
FIG. 108 shows C4 RP-HPLC analyses of the click conjugate reactants and product 3×FA(7),3×MMAE-XTEN, as described in Example 39. (1) 1×DBCO,3×FA(7)-XTEN; (2) 1×Azide,3×MMAE-XTEN; (3) products of click chemistry reaction.
Figure 109:
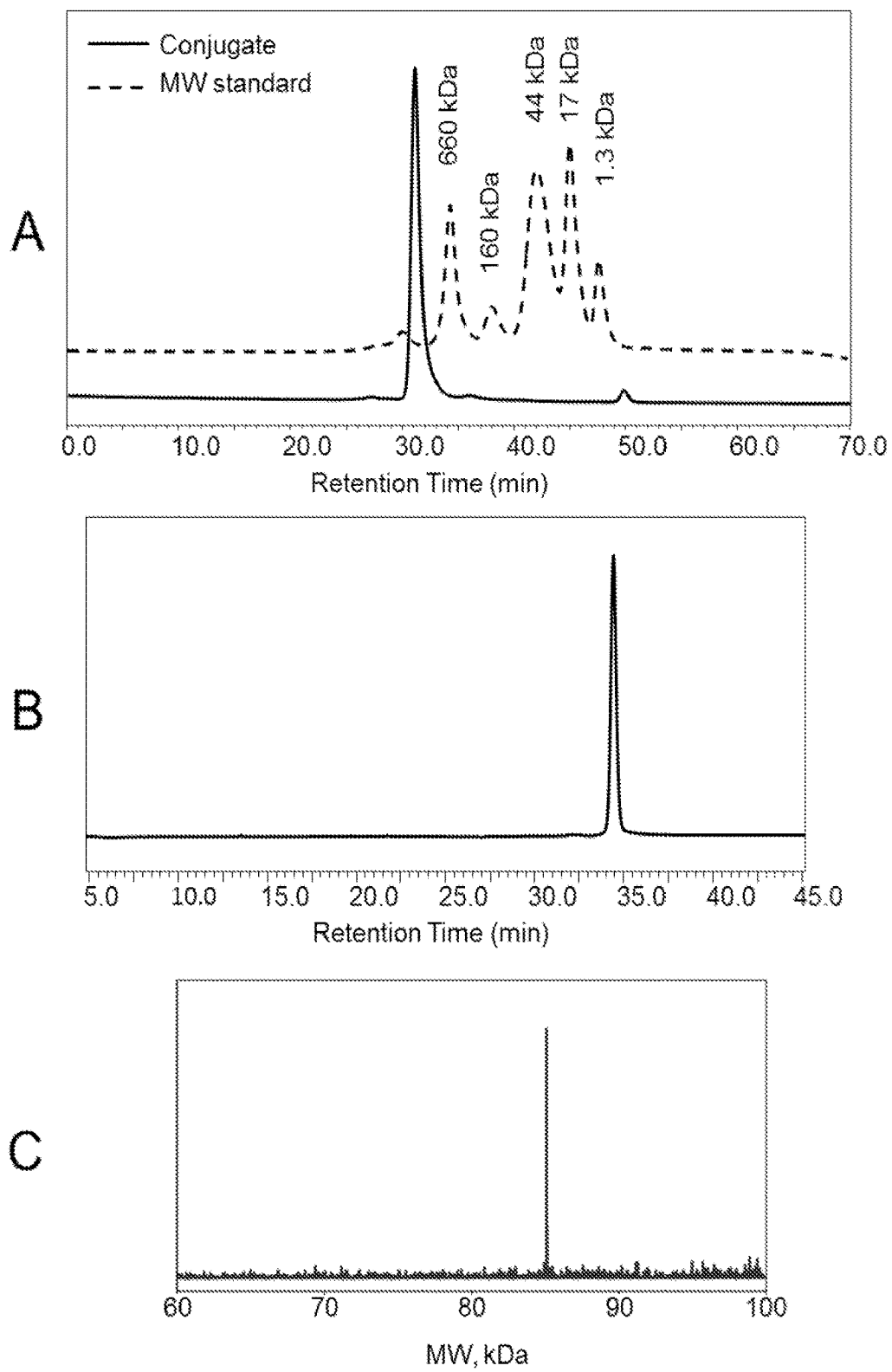
FIG. 109 shows analyses of final 3×FA(7),3×MMAE-XTEN product purified by preparative RP-HPLC, as described in Example 39.

An aliquot of the fusion protein 1×DBCO,3×FA(7)-XTEN432 was prepared as 191 µM (8.8 mg/ml) solution in 20 mM HEPES, pH 7.0. 1×Azide,3×MMAE-XTEN432 (prepared as described in Example 32) was prepared as a 242 µM (11.1 mg/ml) solution in 20 mM HEPES, pH 7.0. The two protein reactants were mixed in solution to yield a 1.1 molar excess of 1×DBCO,3×FA(γ)-XTEN432. The reaction mixture was incubated overnight at 25° C. Completion of the click chemistry reaction was analyzed by RP-HPLC (FIG. 108). The conjugation mixture was diluted to 15 ml with 0.01% TFA and pH adjusted to ~3 using 10% TFA. The protein solution was loaded onto a preparative C4 RP-HPLC column Vydac C4 250×10 mm (Grace Davison Discovery Sciences, cat. #214TP510). The protein was eluted with 180 ml linear 5-50% gradient of acetonitrile in 0.01% TFA at 2 ml/min flow rate. Fractions containing 3×FA(γ),3×MMAE-XTEN were adjusted to ~pH7 with 1 M HEPES pH 8 and concentrated by vacuum evaporation to yield the final product. The final product was analyzed by size exclusion chromatography (SEC-HPLC) (FIG. 109A), RP-HPLC (FIG. 109B) and ESI-MS (FIG. 109C).

The 3×FA(α),3×MMAE-XTEN conjugate was prepared essentially as described above using click reaction between 1×DBCO,3×FA(α)-XTEN432 and 1×Azide,3×MMAE-XTEN432.

Example 40: Comparison of Viscosity in Solutions of Branched Versus Linear XTEN The viscosity of linear and branched XTENs (the latter as trimeric or tetrameric configurations) can be measured using various types of viscometers and rheometers. For example one can measure the time required to draw 1 mL of liquid into a syringe through a 30G needle as described by Miller, M. A., et al. (2010) Langmuir, 26:1067. In order to compare monomeric linear versus trimeric or tetrameric configurations of XTENs to be for viscosity, constructs having equivalent molecular weights for the XTEN amino acid component are prepared and then solutions are made at fixed, equivalent concentrations of protein at 20, 50, 100 mg/ml each. The solutions are then are evaluated using the method of Miller. Using the method, data are obtained with known standards to prepare a standard curve, and then the XTEN solutions are measured. It is expected that results will show that the viscosity of equimolar solutions of XTENs with similar molecular weight will be significantly decrease with increasing branching; a conjugate of 3 arms of XTEN288 will have significantly lower viscosity compared to an equal concentration of linear XTEN864, even though they have equivalent numbers of amino acids. Similarly, it is expected that a configuration with 4 arms of XTEN216 will have even lower viscosity than a conjugate with 3 arms of XTEN288.

Example 41: Preparation of Her2-XTEN-PTX by Conjugation

Figure 92:
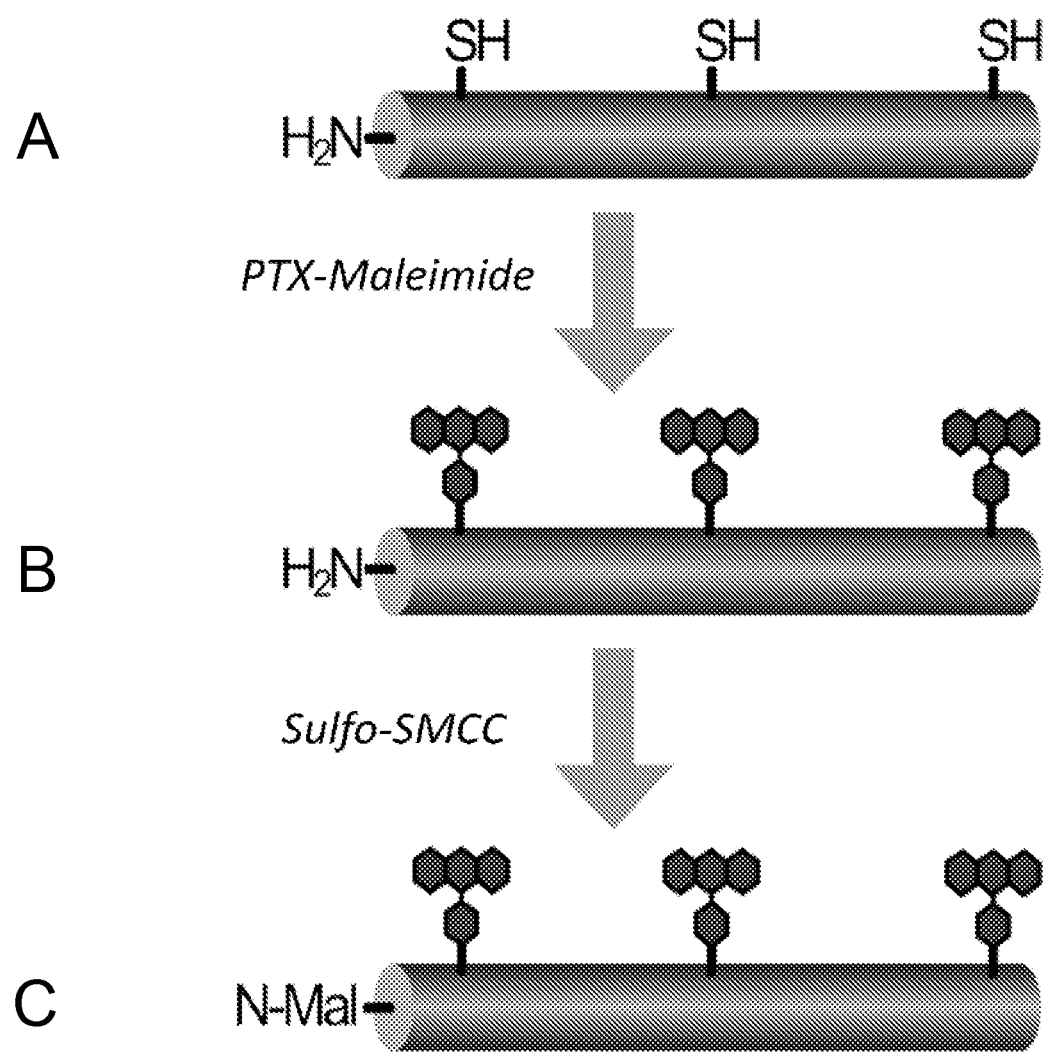
FIG. 92 shows a flow chart of the reaction during preparation of conjugates of 1×Mal,3×PTX-XTEN reactant, as described in Example 41.

An aliquot of the fusion protein 1×Amino,3×Thiol-XTEN432 (XTEN_AE432(Am1,C12,C217,C422)) is prepared as 196 µM (7.7 mg/ml) solution in 20 mM HEPES, pH 7.0, 50 mM NaCl. Paclitaxel-Mal (PTX-Mal) is custom synthesized by modification of paclitaxel with succinic anhydride followed by conjugation to aminoethylmaleimide. PTX-Mal is dissolved in dimethylformamide (DMF) and added to the protein in a 3.5-5× molar excess. The reaction mixture is incubated for 1-2 hr at 25° C. and the products of the reaction are analyzed by C18 RP-HPLC. Sulfo-SMCC (Thermo Scientific, cat. #22122) is dissolved in anhydrous DMF to a final concentration 50 mM and added to the protein solution in a 10× molar excess over protein. The reaction mixture is incubated for 2 hr at 25° C. and the products of the reaction analyzed by C18 RP-HPLC (see FIG. 92). The reaction mixture is diluted to 15 mL with 0.01% TFA and pH adjusted to ~3 using 10% TFA solution. The protein solution is loaded on a preparative C4 RP-HPLC column Vydac C4 250×22 mm (Grace Davison Discovery Sciences, cat. #214TP1022). The protein is eluted with a 1200 ml linear 5-50% gradient of acetonitrile in 0.01% TFA at 15 ml/min flow rate. Fractions containing 1×Mal,3×PTX-XTEN432 are adjusted to ~pH 7 with 1 M HEPES pH 8 and concentrated by vacuum evaporation. Herceptin (Trastuzumab, Roche) antibody is reconstituted in water according to the instructions and is buffer exchanged into PBS pH 7.2 containing 5 mM EDTA. DTT is added to the protein solution to a 1-10 mM final concentration and incubated for 5-30 min at 37° C. Excess DTT is removed by gel filtration or cut-off membrane filtration. 1×Mal,3×PTX-XTEN432 is added to partially reduced antibody in a 3-4× molar excess. The reaction mixture is incubated for 1 hr at 25° C. and the final products of the reaction are analyzed by SDS-PAGE and size exclusion chromatography under non-reducing and reducing conditions.

Example 42: Preparation of Iodoacetyl-XTEN by Conjugation

Figure 93:
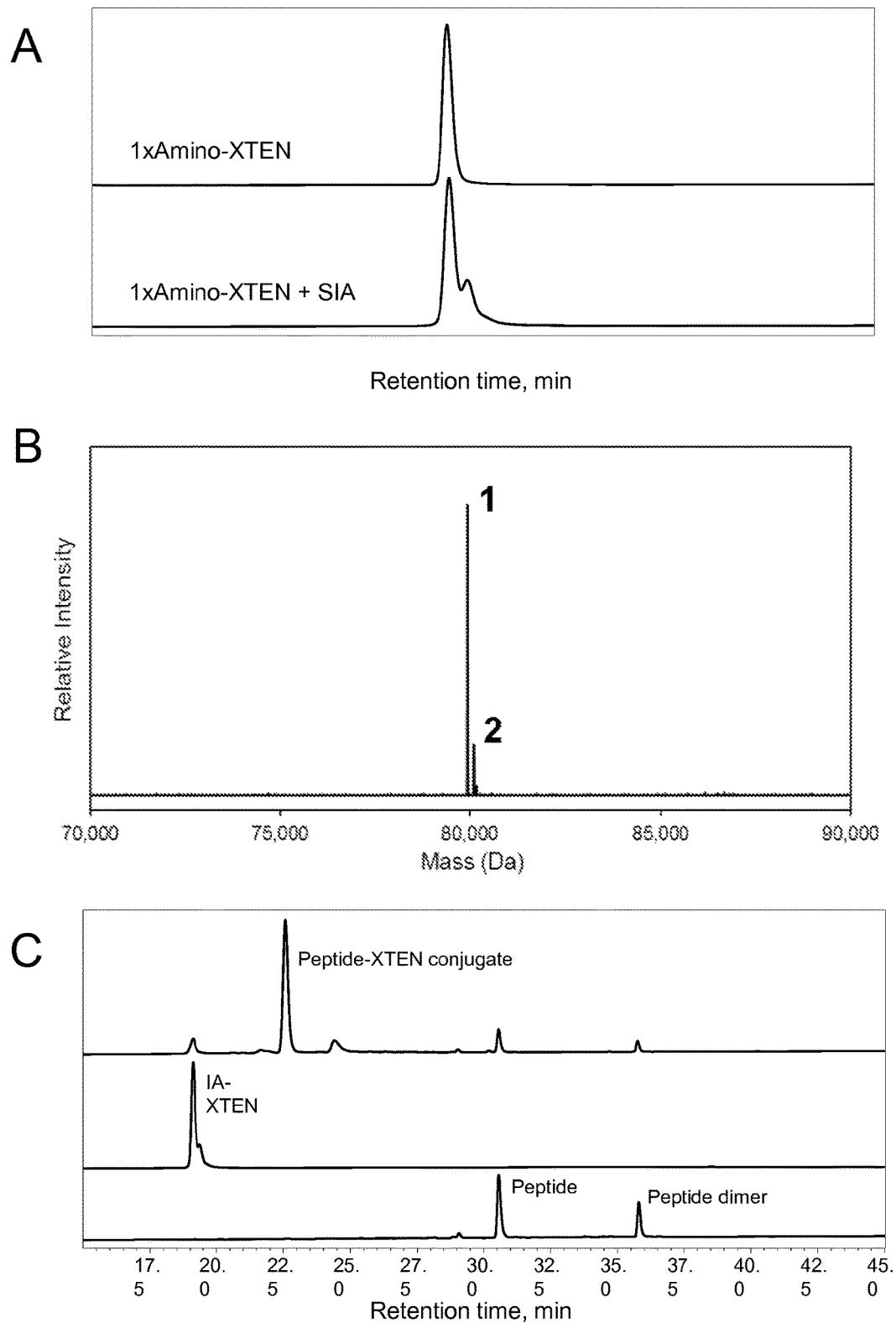
FIG. 93 shows results of analyses of reaction mixtures from the preparation of iodoacetyl-XTEN, as described in Example 42.

An aliquot of the fusion protein 1×Amino-XTEN869 (XTEN_AE869(Am1)) was prepared as a 164 μM (13.1 mg/ml) solution in 20 mM HEPES, pH 7.0, 50 mM NaCl. A 1/20 volume of 1M HEPES pH 8 was added to the protein solution to adjust the pH of the protein solution to ~7.5. N-succinimidyl iodoacetate (SIA, Thermo Scientific, cat. #22349) was dissolved in anhydrous dimethylformamide (DMF) to a final concentration 100 mM and was added in a 10× molar excess over the protein. The reaction mixture was incubated for 1 hr at 25° C. and the products of the reaction are analyzed by C18 RP-HPLC (FIG. 93A). The excess SIA was removed by buffer exchange using Vivaspin 500 ultracentrifugal device (5,000 MWCO, VivaScience, cat. # VS0112). Modification of the N-terminal amino group by iodoacetyl group did not change the retention time of the modified XTEN (FIG. 93A), therefore the covalent modification was confirmed by ESI-MS (FIG. 93B). Also, the IA-XTEN conjugate efficiently reacted with the cysteine-containing peptide HCKFWW (Bachem, cat. # H-3524) (FIG. 93C).

Example 43: In Vitro Cell-Based Screening of LHRH-XTEN-Drug Conjugates for Activity and Specificity LHRH-XTEN-drug conjugates are assessed for in vitro activity and selectivity. Each LHRH-XTEN-drug conjugate, its corresponding non-targeting XTEN-drug molecule and its respective free drug control are tested in a CellTiter-Glo anti-proliferation assay against a panel of LHRH receptor positive and negative cell lines listed in Table 41. Appropriate assay conditions, including optimal cell density and incubation time are determined using the respective free drug as control. LHRH-XTEN-drug conjugates are tested as follows: cells in log-phase are collected, counted and plated at pre-determined cell density in a 96-well microtiter assay plate. Adherent cells are allowed to attach to the plate by an overnight incubation at 37° C. with an atmosphere of 5% $CO_2$. The LHRH-XTEN-drug conjugates and corresponding controls are introduced using appropriate dose range dilutions, in duplicate, and the plates are incubated for an additional 2-5 days. After the appropriate incubation period, CellTiter-Glo reagent is added to each well, mixed for 2 minutes on an orbital shaker. The plate is then centrifuged at 90× g and incubated at room temperature for an additional 10 minutes to stabilize the luminescent signal. Luminescence signals are then read on a luminometer and the $IC_{50}$ (half maximal inhibitory concentration) values are calculated with GraphPad Prism or equivalent software. Quantitative comparisons of the $IC_{50}$ values will enable ranking of the constructs' activity for inhibition of cell growth and selectivity against LHRH receptor positive versus negative cell lines. It is expected that the results would support the finding that the LHRH-XTEN-drug conjugates will show highly selective potent killing on LHRH receptor positive cells but not on LHRH receptor negative cells. This will be in contrast to the free drug moiety whereby no discrimination in cytotoxicity is expected between LHRH receptor positive and negative cell lines. The XTEN-drug control is expected to yield poor cytotoxic activity. LHRH-XTEN-drug conjugates with favorable activity and cell line selectivity relative to controls will be further verified for LHRH receptor association by the addition of free competitive LHRH peptide in the assay, resulting in impaired LHRH-XTEN-drug cytotoxicity, further verifying the selective activity of the constructs.

TABLE 41

LHRH receptor positive and negative cell lines

| Cell line | Tissue | LHRHR status |
|---|---|---|
| MCF-7 | Breast | Positive |
| MDA-MB-231 | Breast (HER2−/ER−/PR−) | Positive |
| HCC1806 | Breast (HER2−/ER−/PR−) | Positive |
| HCC1937 | Breast (HER2−/ER−/PR−) | Positive |
| OV-1063 | Ovarian | Positive |
| EFO-21 | Ovarian | Positive |
| EFO-27 | Ovarian | Positive |
| NIH: OVCAR-3 | Ovarian | Positive |
| BG-1 | Ovarian | Positive |
| HEC-1A | Endometrial | Positive |
| HEC-1B | Endometrial | Positive |
| Ishikawa | Endometrial | Positive |
| KLE | Endometrial | Positive |
| AN-3-CA | Endometrial | Positive |
| MiaPaCa | Pancreatic | Positive |
| Panc-1 | Pancreatic | Positive |
| rat Dunning R-3327-H | Prostate (androgen-dep) | Positive |
| PC-82 | Prostate (androgen-dep) | Positive |
| MDA-PCa-2b | Prostate (androgen-indep) | Positive |
| C4-2 (derivative of LNCaP) | Prostate (androgen-dep) | Positive |
| A549 | Lung | Positive |
| UCI-107 | Ovarian | Negative |
| SK-OV-3 | Ovarian | Negative |
| SW626 | Ovarian | Negative |
| MFE-296 | Endometrial | Negative |

ER: estrogen receptor; PR: progesterone receptor

Example 44: In Vitro Cell-Based Screening of Folate-XTEN-Drug Conjugates for Activity and Specificity Folate-XTEN-drug conjugates are first subjected to an in vitro activity and selectivity screen. Each folate-XTEN-drug conjugate, its corresponding non-targeting XTEN-drug molecule and respective free drug control are tested in a CellTiter-Glo anti-proliferation assay against a panel of folate receptor positive and negative cell lines listed in Table 42. As culture media contain high folic acid content, cells will be grown and the assay performed in folic acid free-media containing 5-10% heat-inactivated fetal calf serum (FCS) at 37° C., in an atmosphere of 5% $CO_2$ (heat-inactivated FCS contains endogenous level of folic acid sufficient for folate receptor expressing cells to survive and proliferate). Appropriate assay conditions are established, including optimal cell density and incubation times, using folate-free media containing 5-10% FCS using the respective free drug as control. Folate-XTEN-drug conjugates are then tested as follows: cells in log-phase are collected, counted and plated at pre-determined cell density in 96-well microtiter assay plates. Adherent cells are allowed to attach to the plate by an overnight incubation at 37° C., 5% $CO_2$. Folate-XTEN-drug conjugates and corresponding controls are introduced using appropriate dose range dilutions, in duplicate, and the plates are incubated for an additional 2-5 days. After the appropriate incubation period, CellTiter-Glo reagent is added to each well and is mixed for 2 minutes on an orbital shaker. The plate is then centrifuged at 90×g and incubated at room temperature for an additional 10 minutes to stabilize the luminescent signal. Luminescence signals are then read on a luminometer and the $IC_{50}$ (half maximal inhibitory concentration) values are calculated with GraphPad Prism or equivalent software. Quantitative comparisons of the $IC_{05}$ values will enable ranking of the constructs' activity for inhibition of cell growth and selectivity against folate receptor positive versus negative cell lines. It is expected that the results would support the finding that the folate-XTEN-drug conjugates will show highly selective potent killing on folate receptor positive cells but not on folate receptor negative cells. This will be in contrast to the free drug moiety where no discrimination in cytotoxicity is expected between folate receptor positive and negative cell lines. The XTEN-drug control is expected to yield poor cytotoxic activity. Folate-XTEN-drug conjugates with favorable activity and cell line selectivity relative to controls will be further verified for folate receptor association by the addition of free competitive folic acid in the assay, demonstrating impaired folate-XTEN-drug cytotoxicity, further verifying the selective activity of the constructs.

TABLE 42

Folate receptor positive and negative cell lines

| Cell line | Tissue | Folate receptor status |
|---|---|---|
| KB | Nasopharyngeal | Positive |
| IGROV | Ovarian | Positive |
| SK-OV-3 | Ovarian | Positive |
| HeLa | Cervical | Positive |
| LoVo | Colorectal | Positive |
| SW620 | Colorectal | Positive |
| A549 | Lung | Negative |
| A375 | Multiple melanoma | Negative |
| LS-174T | Colorectal | Negative |
| SK-BR-3 | Breast | Negative |

Example 45: In Vitro Serum Stability of LHRH-XTEN-Drug Conjugates

As a measure of stability, LHRH-XTEN-drug conjugates are incubated independently in normal human, cynomolgus monkey and mouse plasma at 37° C. for up to 2 weeks with aliquots removed at periodic intervals and stored at −80° C. till analysis. The stability of LHRH-XTEN-drug conjugate can be assessed either by the amount of free drug released or the integrity of the LHRH-XTEN-drug conjugate over time. Free drug is quantitated with RP-HPLC and/or LC-MS/MS whereas the amount of intact LHRH-XTEN-drug conjugate is determined using an XTEN/drug and/or an LHRH/drug ELISA.

For RP-HPLC analysis, plasma samples are treated with organic solvents such as acetonitrile or acetone to precipitate proteins. Soluble fractions are evaporated under vacuum, redissolved in loading solutions and analyzed by RP-HPLC. Analytes are detected by UV absorption at wavelengths specific for the particular drug, compared to known drug standards. For example, doxorubicin is detected at 480 nm. For LC-MS/MS analysis, plasma samples are treated with organic solvents such as acetonitrile or acetone to precipitate proteins. Soluble fractions are evaporated under vacuum, redissolved in loading solutions and analyzed by RP-HPLC. Analytes are detected and quantitated by triple quadrupole tandem mass spectrometry, compared to known drug standards. Parental ion-daughter ion pairs will be determined experimentally for each drug. For quantitative ELISA, optimal concentrations of antibodies for LHRH-XTEN-drug conjugate in the ELISAs are determined using criss-cross serial dilution analysis. An appropriate capture antibody recognizing one component of the conjugate is coated onto a 96-well microtiter plate by an overnight incubation at 4° C. The wells are blocked, washed and serum stability samples added to the wells, each at varying dilutions to allow optimal capture of the LHRH-XTEN-drug conjugate by the coated antibody. After washing, detection antibody recognizing another component of the conjugate is added and allowed to bind to the conjugate captured on the plate. Wells are then washed again and either streptavidin-horseradish peroxidase (complementary to biotinylated version of detection antibody) or an appropriate secondary antibody-horseradish peroxidase (complementary to non-biotinylated version of detection antibody) is then added. After appropriate incubation and a final wash step, tetramethylbenzidine (TMB) substrate is added and the plate read at 450 nM. Concentrations of intact conjugate are then calculated for each time point by comparing the colorimetric response to a calibration curve prepared with LHRH-XTEN-drug in the relevant plasma type. The t½ of the decay of the conjugate in human, cyno and mouse serum is then defined using linear regression analysis of the log concentrations vs. time.

Example 46: In Vitro Serum Stability of Folate-XTEN-Drug Conjugates

As a measure of stability, folate-XTEN-drug conjugates are incubated independently in normal human, cynomolgus monkey and mouse plasma at 37° C. for up to 2 weeks with aliquots removed at periodic intervals and stored at −80° C. until analysis. The stability of folate-XTEN-drug conjugate is assessed either by the amount of free drug or the integrity of the folate-XTEN-drug conjugate over time. Free drug is quantitated with HPLC and/or LC-MS/MS whereas the amount of intact folate-XTEN-drug conjugate is determined using an XTEN/drug and/or folate/drug ELISA.

For RP-HPLC analysis, plasma samples are treated with organic solvents such as acetonitrile or acetone to precipitate proteins. Soluble fractions are evaporated under vacuum, redissolved in loading solutions and analyzed by RP-HPLC. Analytes are detected by UV absorption at wavelength specific for a particular drug, compared to known drug standards. For example, doxorubicin is detected at 480 nm. For LC-MS/MS analysis, plasma samples will be treated with organic solvents such as acetonitrile or acetone to precipitate proteins. Soluble fractions will be evaporated in vacuum, redissolved in loading solutions and analyzed by RP-HPLC. Analytes will be in-line detected and quantitated by triple quadrupole tandem mass spectrometry. Parental ion-daughter ion pairs will be determined experimentally for each drug. Calibration standards will be prepared by adding known amounts of free drug to corresponding plasma type and will be treated in parallel with experimental samples.

For quantitative ELISA, optimal concentrations of antibodies for folate-XTEN-drug conjugate in the ELISAs is determined using criss-cross serial dilution analysis. An appropriate capture antibody recognizing one component of the conjugate is coated onto a 96-well microtiter plate by an overnight incubation at 4° C. The wells are blocked, washed and serum stability samples added to the wells, each at varying dilutions to allow optimal capture of the folate-XTEN-drug conjugate by the coated antibody. After washing, detection antibody recognizing another component of the conjugate is added and allowed to bind to the conjugate captured on the plate. Wells are then washed again and either streptavidin-horseradish peroxidase (complementary to biotinylated version of detection antibody) or an appropriate secondary antibody-horseradish peroxidase (complementary to non-biotinylated version of detection antibody) is then added. After appropriate incubation and a final wash step, tetramethylbenzidine (TMB) substrate is added and the plate is read at 450 nM. Concentrations of intact conjugate are then calculated for each time point by comparing the colorimetric response to a calibration curve prepared with folate-XTEN-drug in the relevant plasma type. The t½ of the decay of the conjugate in human, cyno and mouse serum is then defined using linear regression analysis of the log concentrations vs. time.

Example 47: In Vivo and Ex Vive Imaging of LHRH-XTEN-Cy5.5 Conjugate

A Cy5.5 fluorescent tagged LHRH-XTEN molecule is used as a surrogate to investigate the targeting and biodistribution efficiency of LHRH-XTEN-drug conjugates. Experiments will be carried out in nude mice bearing subcutaneous grown xenografts of LHRH receptor positive tumor cells using in vivo, followed by ex vivo, fluorescence imaging with IVIS 50 optical imaging system (Caliper Life Sciences, Hopkinton, Mass.). In brief, female nu/nu mice bearing LHRH receptor positive tumor cells are given a single intravenous injection of high or low dose LHRH-XTEN-Cy5.5 and corresponding doses of non-targeting Cy5.5 tagged XTEN control. Whole body scans are acquired pre-injection and then at approximately 8, 24, 48 and 72 hours post-injection on live anesthetized animals using the IVIS 50 optical imaging system. After measuring the distribution of fluorescence in the entire animal at the last time point of 72 h, tumor and healthy organs including liver, lung, heart, spleen and kidneys are excised and their fluorescence registered and processed by the imaging system. Cy5.5 excitation (615-665 nm) and emission (695-770 nm) filters are selected to match the fluorescence agents' wavelengths. Small and medium binning of the CCD chip is used and the exposure time optimized to obtain at least several thousand counts from the signals observable in each mouse in the image and to avoid saturation of the CCD chip. To normalize images for quantification, a background fluorescence image is acquired using background excitation and emission filters for the Cy5.5 spectral region. The intensity of fluorescence is expressed as different colors with blue color reflecting the lowest intensity and red being indicative of the highest intensity, and the resulting images are used to assess the uptake of the conjugates and controls.

Example 48: In Vivo and Ex Vivo Imaging of Folate-XTEN-Cy5.5 Conjugates

A Cy5.5 fluorescent tagged folate-XTEN molecule is used as a surrogate to investigate the targeting and biodistribution efficiency of folate-XTEN-drug conjugates. Experiments will be carried out in nude mice bearing subcutaneous grown xenografts of folate receptor positive tumor cells using in vivo, followed by ex vivo, fluorescence imaging with IVIS 50 optical imaging system (Caliper Life Sciences, Hopkinton, Mass.). As culture media contain high folate content, folate receptor positive tumor cells to be transplanted onto these mice will be grown in folate-free cell culture media containing 5-10% heat-inactivated FCS with no antibiotics. Similarly, normal rodent chow contains a high concentration of folic acid; nude mice used in this study will be maintained on folate-free diet 2 weeks prior to tumor implantation and for the duration of the imaging analysis to reduce serum folate concentration.

In brief, female nu/nu mice bearing folate receptor positive tumor cells are given a single intravenous injection of high or low dose folate-XTEN-Cy5.5 and corresponding doses of non-targeting Cy5.5 tagged XTEN control. Whole body scans are acquired pre-injection and then at approximately 8, 24, 48 and 72 hours post-injection on live anesthetized animals using the IVIS 50 optical imaging system. After measuring the distribution of fluorescence in the entire animal at the last time point of 72 h, tumor and healthy organs including liver, lung, heart, spleen and kidneys are excised and their fluorescence registered and processed by the imaging system. Cy5.5 excitation (615-665 nm) and emission (695-770 nm) filters are selected to match the fluorescence agents' wavelengths. Small and medium binning of the CCD chip is used and the exposure time optimized to obtain at least several thousand counts from the signals that were observable in each mouse in the image and to avoid saturation of the CCD chip. To normalize images for quantification, a background fluorescence image is acquired using background excitation and emission filters for the Cy5.5 spectral region. The intensity of fluorescence is expressed as different colors with blue color reflecting the lowest intensity and red being indicative of the highest intensity, and the resulting images are used to assess the uptake of the conjugates and controls.

Example 49: Pharmacokinetic Analysis of LHRH-XTEN-Drug Conjugates

The in vivo pharmacokinetics of LHRH-XTEN-drug constructs are assessed using standard methods for protein compositions using mice, rats, cynomolgus monkeys, and dogs. Compositions of LHRH-XTEN-drug constructs are provided in an aqueous buffer compatible with in vivo administration (for example: phosphate-buffered saline, Tris-buffered saline or Hepes-buffered saline). The compositions are administered at appropriate doses and via multiple routes: most preferably via intravenous or subcutaneous routes. Blood samples are collected at appropriate time points ranging from 0.08 to 504 hours, and processed into plasma. Plasma samples are analyzed for concentration of LHRH-XTEN-drug conjugates by one of a variety of methods, including ELISA, HPLC and/or LC-MS/MS. ELISA analysis are performed using a sandwich ELISA format that can recognize 2 components of the LHRH-XTEN-drug conjugate, for instance, XTEN/LHRH, XTEN/drug moiety, LHRH/drug moiety and/or XTEN/XTEN combinations. Typically antibody recognizing one component of the LHRH-XTEN-drug conjugate is coated onto wells of a 96-well microtiter plate. The wells are blocked, washed and plasma samples are then added to the wells at varying dilutions to allow capture of the conjugate by the coated antibody. Wells are then washed extensively, and bound protein detected using either a biotinylated antibody or an appropriate secondary antibody against the second LHRH-XTEN-drug conjugate component. Wells are then washed again and streptavidin-horseradish peroxidase (complementary to the biotinylated detection antibody) or a secondary antibody-horseradish peroxidase (complementary to a non biotinylated detection antibody) is then added. After appropriate incubation and a final wash step, tetramethylbenzidine (TMB) substrate is added and the plate is read at 450 nM. Concentrations of conjugate are then calculated for each time point by comparing the colorimetric response to a LHRH-XTEN-drug calibration curve. Pharmacokinetic parameters are calculated using the WinNonLin software package.

For RP-HPLC analysis, plasma samples are treated with organic solvents such as acetonitrile or acetone to precipitate proteins. Soluble fractions are evaporated in vacuum, redissolved in loading solutions and analyzed by RP-HPLC. Analytes are detected by UV absorption at wavelength specific for a particular drug. For example, doxorubicin is detected at 480 nm. Calibration standards are prepared by adding known amounts of free drug to corresponding plasma type and are assayed in parallel with experimental samples.

For LC-MS/MS analysis, plasma samples are treated with organic solvents such as acetonitrile or acetone to precipitate proteins. Soluble fractions are evaporated under vacuum, redissolved in loading solutions and analyzed by RP-HPLC. Analytes are in-line detected and quantitated by triple quadrupole tandem mass spectrometry. Parental ion-daughter ion pairs are determined experimentally for each drug. Calibration standards are prepared by adding known amounts of free drug to corresponding plasma type and are assayed in parallel with experimental samples.

It is expected that the results would support the finding that addition of an XTEN to LHRH and drug moiety will greatly increase the terminal half-life and enhance the pharmacokinetic properties of targeting and drug moiety not linked to XTEN.

Example 50: Pharmacokinetic Analysis of Folate-XTEN-Drug Conjugates

The in vivo pharmacokinetics of folate-XTEN-drug constructs are assessed using standard methods for protein compositions using mice, rats, cynomolgus monkeys, and dogs. As normal feed contains a high concentration of folic acid (approx. 6 mg/kg mouse chow), animals to be used in pharmacokinetic studies of folate conjugates will be maintained on folate-free diet for 2 weeks prior to study initiation and for the duration of the study. The compositions are administered at appropriate doses and via multiple routes: most preferably via intravenous or subcutaneous routes. Blood samples are collected at appropriate time points ranging from 0.08 to 504 hours, and processed into plasma. Plasma samples are analyzed for concentration of folate-XTEN-drug conjugates by a variety of methods including ELISA, HPLC and/or LC-MS/MS.

ELISA analysis are performed using a sandwich ELISA format that can recognize 2 components of the folate-XTEN-drug conjugate, for instance, XTEN/folate, XTEN/drug moiety, folate/drug moiety and/or XTEN/XTEN combinations. Typically antibody recognizing one component of the folate-XTEN-drug conjugate is coated onto wells of a 96-well microtiter plate. The wells are blocked, washed and plasma samples are then added to the wells at varying dilutions to allow capture of the conjugate by the coated antibody. Wells are then washed extensively, and bound protein detected using either a biotinylated antibody or an appropriate secondary antibody against the second folate-XTEN-drug conjugate component. Wells are then washed again and streptavidin-horseradish peroxidase (complementary to the biotinylated detection antibody) or a secondary antibody-horseradish peroxidase (complementary to a non biotinylated detection antibody) is then added. After appropriate incubation and a final wash step, tetramethylbenzidine (TMB) substrate is added and the plate is read at 450 nM. Concentrations of conjugate are then calculated for each time point by comparing the colorimetric response to a folate-XTEN-drug calibration curve. Pharmacokinetic parameters are calculated using the WinNonLin software package.

For RP-HPLC analysis, plasma samples are treated with organic solvents such as acetonitrile or acetone to precipitate proteins. Soluble fractions are evaporated in vacuum, redissolved in loading solutions and analyzed by RP-HPLC. Analytes are detected by UV absorption at wavelength specific for a particular drug. For example, doxorubicin is detected at 480 nm. Calibration standards are prepared by adding known amounts of free drug to corresponding plasma type and are assayed in parallel with experimental samples.

For LC-MS/MS analysis, plasma samples are treated with organic solvents such as acetonitrile or acetone to precipitate proteins. Soluble fractions are evaporated under vacuum, redissolved in loading solutions and analyzed by RP-HPLC. Analytes are in-line detected and quantitated by triple quadrupole tandem mass spectrometry. Parental ion-daughter ion pairs are determined experimentally for each drug. Calibration standards are prepared by adding known amounts of free drug to corresponding plasma type and are assayed in parallel with experimental samples.

It is expected that the results would support the finding that addition of an XTEN to folate and drug moiety will greatly increase the terminal half-life and enhance the pharmacokinetic properties of targeting and drug moiety not linked to XTEN.

Example 51: In Vivo Efficacy and Toxicity Analysis of LHRH-XTEN-Drug Conjugates

LHRH-XTEN-drug conjugate is intended for targeted delivery of highly potent toxin to LHRH receptor positive tumor cells. As such, the in vivo pharmacologic activity of LHRH-XTEN-drug constructs can be assessed using human tumor cells expressing LHRH receptor transplanted into nude mice.

Prior to beginning the efficacy study, an initial assessment in nude mice is carried out to establish the maximum tolerated dose (MTD) of the LHRH-XTEN-drug candidates. The MTD, the highest dose that is tolerated by the animal for the study duration, will then be used to calculate the dose range for the efficacy and toxicity study in the standard xenograft model. Briefly, the MTD experiment is carried out with 5 mice per group evaluating the intravenous administration of LHRH-XTEN-drug conjugates at various dose level, interval and duration. The starting MTD dose and number of dose groups required is based on scientific literature, knowledge of the targeting LHRH moiety, the nature of the drug moiety conjugated, toxicological properties of closely related compounds, and data from the initial pharmacokinetic studies (see, above). Standard MTD parameters such as reduction in body weight, food and water consumption and signs of piloerection, hunched, behavior patterns, respiratory pattern, tremors, convulsions, prostration and self-mutilation are monitored on a daily basis. The highest dose of LHRH-XTEN-drug that does not cause unacceptable toxicity will be assigned as the MTD. The tumor xenograft study will include 3 to 4 dosing levels of LHRH-XTEN-drug conjugate and will depend on the results from the MTD study; with other parameters depending on the tumor cell line chosen. Table 42 provides examples of tumor lines that can be used in the xenograft study. Thus, an appropriate number of LHRH receptor positive cells from the relevant human tumor line are injected subcutaneously and allowed to form tumors, the size of which will be measured with calipers and the volume calculated as $0.5 \times L \times W^2$, where L=measurement of longest axis in millimeters and W=measurement of axis perpendicular to L in millimeters. Following randomization of mice containing tumor volume in the desired size range into groups of 8-10 animals, vehicle control, free drug control and LHRH-XTEN-drug conjugate is administered intravenously at the chosen doses and interval. Cessation or regression of tumor growth is determined by measuring the tumor size and volume at selected time points with calipers. Body weights and food consumption are measured every 1 to 2 days to assess gross toxicity. Survival of animals is monitored daily. At the end of the study, all animals are sacrificed and clinical pathology and histopathology on major organs is performed.

It is anticipated that the results would support the finding that the LHRH-XTEN-drug conjugate will produce a positive therapeutic index as exhibited by potent efficacy and low systemic toxicity. In contrast, the non-LHRH targeted free drug dosed at equimolar doses is expected to be less potent but highly more toxic. It is expected that the vehicle control will display uncontrolled tumor growth and severe toxicity.

Example 52: In Vivo Efficacy and Toxicity Analysis of Folate-XTEN-Drug Conjugates Folate-XTEN-drug conjugates are intended for targeted delivery of the toxin component to folate receptor positive tumor cells. The in vivo pharmacologic activity of folate-XTEN-drug constructs is assessed using human tumor cell expressing folate receptor xenograft onto nude mice. Prior to beginning the efficacy study, an initial assessment in nude mice is carried out to establish the maximum tolerated dose (MTD) of the folate-XTEN-drug candidates. The MTD, the highest dose that will be tolerated by the animal for the study duration, is then used to calculate the dose range for the efficacy and toxicity study in the standard xenograft model. As normal rodent chow contains a high concentration of folic acid (6 mg/kg chow), mice to be used in these studies are maintained on a folate-free diet for 2 weeks prior to study initiation and for the duration of the study. The MTD experiment is carried out with 5 mice per group evaluating the intravenous administration of folate-XTEN-drug conjugates at various dose level, interval and duration. The starting MTD dose and number of dose groups required is based on scientific literature, knowledge of the targeting folate moiety, the nature of the drug moiety conjugated, toxicological properties of closely related compounds, and data from the initial pharmacokinetic studies (see PK Example above). Standard MTD parameters such as reduction in body weight, food and water consumption and signs of piloerection, hunched, behavior patterns, respiratory pattern, tremors, convulsions, prostration and self-mutilation are carefully monitored on a daily basis. The highest dose of folate-XTEN-drug that does not cause unacceptable toxicity is assigned as the MTD.

The tumor xenograft study includes 3 to 4 dosing levels of folate-XTEN-drug, depending on the results from the MTD study, with other parameters depending on the tumor cell line chosen. Table 42 describes examples of tumor lines that can be used in the xenograft study. To reduce folate content, folate receptor positive tumor cells to be transplanted onto nude mice are grown in folate-free cell culture media containing 5-10% heat-inactivated fetal calf serum with no antibiotics. Similarly, to reduce serum folate concentration, mice used in the xenograft studies are maintained on folate-free diet 2 weeks prior to tumor implantation and for the duration of the study. An appropriate number of folate receptor positive cells from the relevant line are injected subcutaneously and allowed to form tumors, the size of which are measured with calipers and the volume calculated as $0.5 \times L \times W^2$, where L=measurement of longest axis in millimeters and W=measurement of axis perpendicular to L in millimeters. Following randomization of mice containing tumor volume in the desired size range into groups of 8-10 animals, vehicle control, free drug control and folate-XTEN-drug is administered intravenously at the chosen doses and intervals. Cessation or regression of tumor growth is determined through measuring the tumor size and volume at selected time points with calipers. Body weight and food consumption is measured every 1 to 2 days to assess gross toxicity. Survival of animals is monitored daily. At the end of study, all animals are sacrificed and major organs will be removed for clinical pathology and histopathology examination.

It is anticipated that the targeted chemotherapeutic folate-XTEN-drug conjugate will be more effective and less toxic than free cytotoxic drug alone on folate receptor positive tumors in the mouse model.

Example 53: Human Clinical Trial Designs for Evaluating LHRH-XTEN-Drug Conjugates Targeted chemotherapy is a modern approach aimed at increasing the efficacy of systemic chemotherapy and reducing side effects. LHRH is a peptide that functions in reproductive organs. Because its receptors are particularly concentrated on certain tumors but are not expressed in most normal tissue, the LHRH receptor is an ideal target for selective destruction of malignant tumors. Indeed, ~52% of breast, ~80% of ovarian and endometrial, and ~85% of prostate cancer specimens is targetable via the LHRH receptor. Of note, LHRH-dependent therapies would be especially useful for triple negative breast tumors, which do not overexpress estrogen or progesterone receptors or HER2 and are therefore unsuitable for treatment with many available targeted drugs. Patients with advanced endometrial, ovarian, or prostate cancer often have particularly poor outcomes, as these malignancies can be prone to recurrence and/or resistant to current treatments. Fusion of a XTEN carrying ≥1 copy of LHRH to a XTEN bearing ≥3 drug molecules to create a targeted peptide-drug conjugate is expected to have vastly improved therapeutic index and half-life that will enable dosing at levels way below MTD, reduce dosing frequency and cost (reduced drug required per dose).

Clinical evaluation of a LHRH-XTEN-drug composition is conducted in patients suffering from advanced breast, endometrial, ovarian, and prostate or bladder cancers, with trials designed to confirm the efficacy and safety of the LHRH-XTEN-drug conjugate in humans. Such studies in patients would comprise three phases. First, a Phase I safety and pharmacokinetics study would be conducted to determine the maximum tolerated dose (MTD) and to characterize the dose-limiting toxicity, pharmacokinetics and preliminary pharmacodynamics in humans. These initial studies could be performed in patients with metastatic or unresectable cancers and for which standard curative or palliative measures could not be used or were no longer effective or tolerated, and LHRH receptor positive status in the patients would be an enrollment criteria. The scheme of the phase I study would be to use single escalating doses of LHRH-XTEN-drug conjugate and to measure the biochemical, PK, and clinical parameters, permitting the determination of the MTD and the threshold and maximum concentrations in dosage and in circulating drug that constitute the therapeutic window to be used in subsequent Phase II and Phase III trials, as well as defining potential toxicities and adverse events to be tracked in future studies.

Phase II clinical studies of human patients would be independently conducted in LHRH receptor positive advanced (stage 3 or 4) or recurrent breast, endometrial, ovarian, and prostate or bladder cancer patients. The trial would evaluate the efficacy and safety of LHRH-XTEN-drug conjugate alone and in combination with a current chemotherapy employed in the specific indication. Patients will receive intravenously administered LHRH-XTEN-drug clinical candidate at a dose level and regimen pre-determined in Phase I with or without the standard chemotherapeutic agent. A control arm comprising of the chemotherapeutic agent plus placebo would be included. The primary endpoint would be response rate as defined by the Response Evaluation Criteria in Solid Tumors (RECIST). Secondary endpoints will include safety and tolerability, time-to-progression and overall survival.

A phase III efficacy and safety study is conducted in LHRH receptor positive advanced (resistant, recurrent) breast, endometrial, ovarian, and prostate or bladder cancer patients to test ability to reach statistically significant clinical endpoints such as progression-free-survival as measured by RECIST. The trial will also be statistically powered for overall survival as a secondary endpoint with projected enrollment in excess of 400 patients. Efficacy outcomes are determined using standard statistical methods. Toxicity and adverse event markers are also followed in the study to verify that the compound is safe when used in the manner described.

Example 54: Human Clinical Trial Designs for Evaluating Folate-XTEN-Drug Conjugates Targeted chemotherapy is a modern approach aimed at increasing the efficacy of systemic chemotherapy and reducing its side effects. Folate, also known as folic acid, vitamin $B_9$, is a vital nutrient required by all living cells for nucleotide biosynthesis and function as cofactor in certain biological pathways. The folate receptor is a focus for the development of therapies to treat fast dividing malignancies; in particular ovarian cancer and non-small cell lung carcinoma. While folate receptor expression is negligible in normal ovary, ~90% of epithelial ovarian cancers overexpress the folate receptor, as do many lung adenocarinomas, thereby opening the possibility of directed therapies. Fusion of a XTEN carrying ≥1 copy of folate to a XTEN bearing ≥3 drug molecules to create a targeted peptide-drug conjugate is expected to improve the therapeutic index and the extended half-life will enable dosing at levels way below maximum tolerated dose (MTD), reduce dosing frequency and cost (reduced drug required per dose).

Clinical evaluation of folate-XTEN-drug composition is conducted in patients with relapsed or refractory advanced tumors or in patients suffering from platinum-resistant ovarian cancer and non-small cell lung carcinoma who have failed using other chemotherapies. Clinical trials are designed to determine the efficacy and advantages of the folate-XTEN-drug conjugate over standard therapies in humans. Such studies in patients would comprise three phases. First, a Phase I safety and pharmacokinetics study is conducted to determine the MTD and to characterize the dose-limiting toxicity, pharmacokinetics and preliminary pharmacodynamics in humans. These initial studies could be performed in patients with folate receptor positive status that have relapsed or have refractory advanced tumors and for which standard curative or palliative measures could not be used or were no longer effective or tolerated. The phase I study would use single escalating doses of folate-XTEN-drug conjugate and would measure biochemical, PK, and clinical parameters to permit the determination of the MTD and establish the threshold and maximum concentrations in dosage and in circulating drug that constitute the therapeutic window to be used in subsequent Phase II and Phase III trials as well as defining potential toxicities and adverse events to be tracked in future studies.

Phase II clinical studies of human patients would be independently conducted in folate receptor positive platinum-resistant ovarian cancer patient population, non-small cell lung carcinoma patients having failed numerous chemotherapies, and patients suffering from relapsed or refractory advanced tumors. The trials would evaluate the efficacy and safety of folate-XTEN-drug conjugate alone and in combination with a current chemotherapy employed in the specific indication. Patients will receive intravenously administered folate-XTEN-drug conjugate at a dose level and regimen determined in the Phase I study with or without the standard chemotherapy agent. A control arm comprising of the chemotherapy agent plus placebo would be included. The primary endpoint would be response rate as defined by the Response Evaluation Criteria in Solid Tumors (RECIST). Secondary endpoints will include safety and tolerability, time-to-progression and overall survival.

A phase III efficacy and safety study is conducted in folate-receptor positive platinum-resistant ovarian cancer patients, non-small cell lung carcinoma patients, or advanced tumor relapsed or refractory patients cancer patients to test ability to reach statistically significant clinical endpoints such as progression-free-survival as measured by RECIST. The trial will also be statistically powered for overall survival as a secondary endpoint with projected enrollment in excess of 400 patients. Efficacy outcomes are determined using standard statistical methods. Toxicity and adverse event markers are also followed in the study to verify that the compound is safe when used in the manner described.

Example 55: Serum Stability of XTEN

Figure 76:
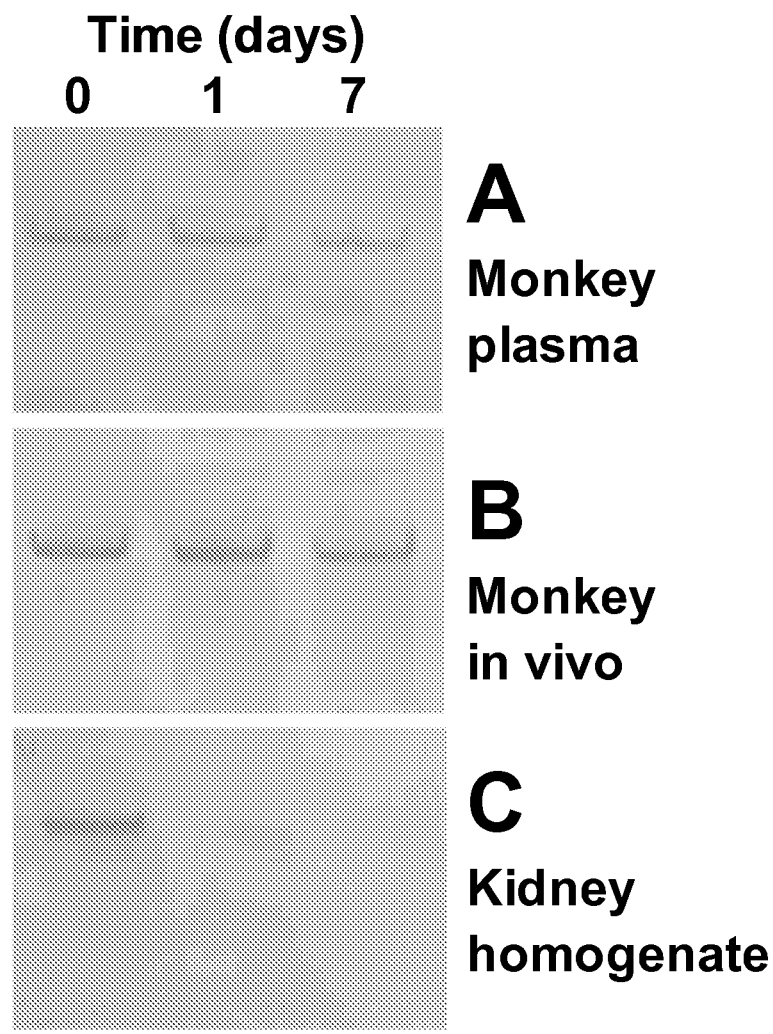
FIG. 76 shows an SDS-PAGE gel of samples from a stability study of the fusion protein of XTEN_AE864 fused to the N-terminus of GFP. The GFP-XTEN was incubated in cynomolgus plasma and rat kidney lysate for up to 7 days at 37° C., as described in Example 55. In addition, GFP-XTEN administered to cynomolgus monkeys was also assessed. Samples were withdrawn at 0, 1 and 7 days and analyzed by SDS PAGE followed by detection using Western analysis and detection with antibodies against GFP.

A fusion protein containing XTEN_AE864 fused to the N-terminus of GFP was incubated in monkey plasma and rat kidney lysate for up to 7 days at 37° C. Samples were withdrawn at time 0, Day 1 and Day 7 and analyzed by SDS PAGE followed by detection using Western analysis and detection with antibodies against GFP as shown in FIG. 76. The sequence of XTEN_AE864 showed negligible signs of degradation over 7 days in plasma. However, XTEN_AE864 was rapidly degraded in rat kidney lysate over 3 days. The in vivo stability of the fusion protein was tested in plasma samples wherein the GFP_AE864 was immunoprecipitated and analyzed by SDS PAGE as described above. Samples that were withdrawn up to 7 days after injection showed very few signs of degradation. The results demonstrate the resistance of aaT-XTEN to degradation due to serum proteases; a factor in the enhancement of pharmacokinetic properties of the aaT-XTEN fusion proteins.

Example 56: Characterization of Secondary Structure of XTEN Linked to Exendin-4

Figure 77:
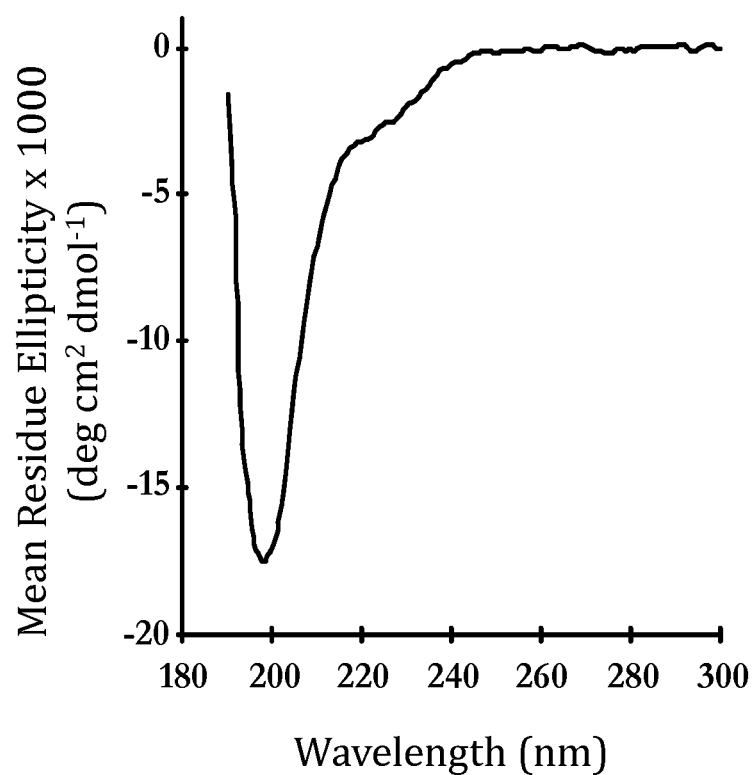
FIG. 77 shows the near UV circular dichroism spectrum of Ex4-XTEN_AE864, performed as described in Example 56.

The XTEN_AE864-Ex4 was evaluated for degree of secondary structure by circular dichroism spectroscopy. CD spectroscopy was performed on a Jasco J-715 (Jasco Corporation, Tokyo, Japan) spectropolarimeter equipped with Jasco Peltier temperature controller (TPC-348WI). The concentration of protein was adjusted to 0.2 mg/mL in 20 mM sodium phosphate pH 7.0, 50 mM NaCl. The experiments were carried out using HELLMA quartz cells with an optical path-length of 0.1 cm. The CD spectra were acquired at 5°, 25°, 45°, and 65° C. and processed using the J-700 version 1.08.01 (Build 1) Jasco software for Windows. The samples were equilibrated at each temperature for 5 min before performing CD measurements. All spectra were recorded in duplicate from 300 nm to 185 nm using a bandwidth of 1 nm and a time constant of 2 sec, at a scan speed of 100 nm/min. The CD spectrum shown in FIG. 77 shows no evidence of stable secondary structure and is consistent with an unstructured polypeptide.

Example 57: Increasing Solubility and Stability of a Peptide Payload by Linking to XTEN In order to evaluate the ability of XTEN to enhance the physicochemical properties of solubility and stability, fusion proteins of glucagon plus shorter-length XTEN were prepared and evaluated. The test articles were prepared in Tris-buffered saline at neutral pH and characterization of the Gcg-XTEN solution was by reverse-phase HPLC and size exclusion chromatography to affirm that the protein was homogeneous and non-aggregated in solution. The data are presented in Table 43. For comparative purposes, the solubility limit of unmodified glucagon in the same buffer was measured at 60 µM (0.2 mg/mL), and the result demonstrate that for all lengths of XTEN added, a substantial increase in solubility was attained. Importantly, in most cases the glucagon-XTEN fusion proteins were prepared to achieve target concentrations and were not evaluated to determine the maximum solubility limits for the given construct. However, in the case of glucagon linked to the AF-144 XTEN, the limit of solubility was determined, with the result that a 60-fold increase in solubility was achieved, compared to glucagon not linked to XTEN. In addition, the glucagon-AF144 was evaluated for stability, and was found to be stable in liquid formulation for at least 6 months under refrigerated conditions and for approximately one month at 37° C. (data not shown).

The data support the conclusion that the linking of short-length XTEN polypeptides to a biologically active protein such as glucagon can markedly enhance the solubility properties of the protein by the resulting fusion protein, as well as confer stability at the higher protein concentrations.

TABLE 43

| Solubility of Glucagon-XTEN constructs | |
|---|---|
| Test Article | Solubility |
| Glucagon | 60 µM |
| Glucagon-Y36 | >370 µM |
| Glucagon-Y72 | >293 µM |

TABLE 43-continued

| Solubility of Glucagon-XTEN constructs | |
|---|---|
| Test Article | Solubility |
| Glucagon-AF108 | >145 µM |
| Glucagon-AF120 | >160 µM |
| Glucagon-Y144 | >497 µM |
| Glucagon-AE144 | >467 µM |
| Glucagon-AF144 | >3600 µM |
| Glucagon-Y288 | >163 µM |

Figure 78:
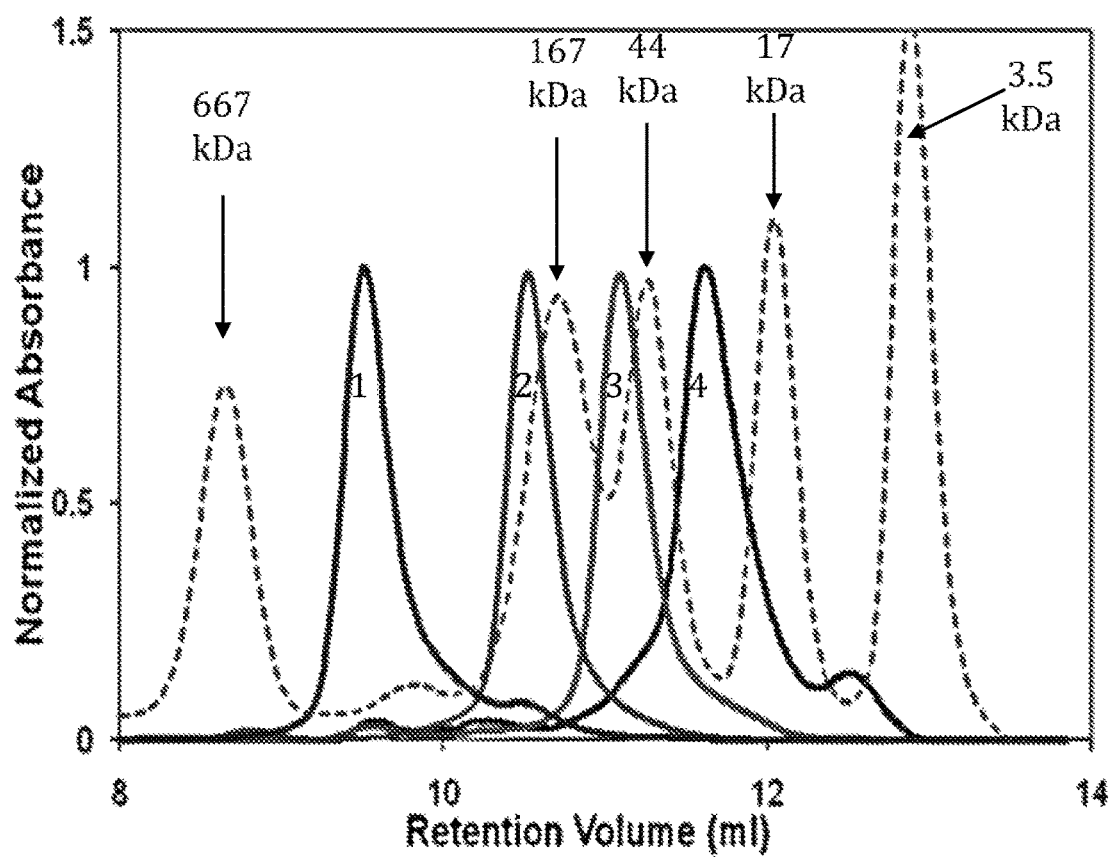
FIG. 78 shows results of a size exclusion chromatography analysis of glucagon-XTEN construct samples measured against protein standards of known molecular weight, with the graph output as absorbance versus retention volume, as described in Example 58. The glucagon-XTEN constructs are 1) glucagon-Y288; 2) glucagonY-144; 3) glucagon-Y72; and 4) glucagon-Y36.

Example 58: Analytical Size Exclusion Chromatography of XTEN Linked with Diverse Payloads Size exclusion chromatography analyses were performed on fusion proteins containing various therapeutic proteins and unstructured recombinant proteins of increasing length. An exemplary assay used a TSKGel-G4000 SWXL (7.8 mm×30 cm) column in which 40 µg of purified glucagon fusion protein at a concentration of 1 mg/ml was separated at a flow rate of 0.6 ml/min in 20 mM phosphate pH 6.8, 114 mM NaCl. Chromatogram profiles were monitored using OD214 nm and OD280 nm. Column calibration for all assays were performed using a size exclusion calibration standard from BioRad; the markers include thyroglobulin (670 kDa), bovine gamma-globulin (158 kDa), chicken ovalbumin (44 kDa), equine myoglobuin (17 kDa) and vitamin B12 (1.35 kDa). Representative chromatographic profiles of Glucagon-Y288, Glucagon-Y144, Glucagon-Y72, Glucagon-Y36 are shown as an overlay in FIG. 78. The data show that the molecular weight of each compound is proportional to the length of the attached XTEN sequence. However, the data also show that the apparent molecular weight of each construct is significantly larger than that expected for a globular protein (as shown by comparison to the standard proteins run in the same assay). Based on the SEC analyses for all constructs evaluated, the apparent molecular weights, the apparent molecular weight factor (expressed as the ratio of apparent molecular weight to the calculated molecular weight) and the hydrodynamic radius ($R_H$ in nm) are shown in Table 44. The results indicate that incorporation of different XTENs of 576 amino acids or greater confers an apparent molecular weight for the fusion protein of approximately 339 kDa to 760, and that XTEN of 864 amino acids or greater confers an apparent molecular weight greater than approximately 800 kDA. The results of proportional increases in apparent molecular weight to actual molecular weight were consistent for fusion proteins created with XTEN from several different motif families; i.e., AD, AE, AF, AG, and AM, with increases of at least four-fold and ratios as high as about 17-fold. Additionally, the incorporation of XTEN fusion partners with 576 amino acids or more into fusion proteins with the various payloads (and 288 residues in the case of glucagon fused to Y288) resulted with a hydrodynamic radius of 7 nm or greater, well beyond the glomerular pore size of approximately 3-5 nm. Accordingly, it is expected that fusion proteins comprising growth and XTEN have reduced renal clearance, contributing to increased terminal half-life and improving the therapeutic or biologic effect relative to a corresponding un-fused biologic payload protein.

TABLE 44

SEC analysis of various polypeptides

| Construct Name | XTEN or fusion partner | Therapeutic Protein | Actual MW (kDa) | Apparent MW (kDa) | Apparent Molecular Weight Factor | $R_H$ (nm) |
|---|---|---|---|---|---|---|
| AC14 | Y288 | Glucagon | 28.7 | 370 | 12.9 | 7.0 |
| AC28 | Y144 | Glucagon | 16.1 | 117 | 7.3 | 5.0 |
| AC34 | Y72 | Glucagon | 9.9 | 58.6 | 5.9 | 3.8 |
| AC33 | Y36 | Glucagon | 6.8 | 29.4 | 4.3 | 2.6 |
| AC89 | AF120 | Glucagon | 14.1 | 76.4 | 5.4 | 4.3 |
| AC88 | AF108 | Glucagon | 13.1 | 61.2 | 4.7 | 3.9 |
| AC73 | AF144 | Glucagon | 16.3 | 95.2 | 5.8 | 4.7 |
| AC53 | AG576 | GFP | 74.9 | 339 | 4.5 | 7.0 |
| AC39 | AD576 | GFP | 76.4 | 546 | 7.1 | 7.7 |
| AC41 | AE576 | GFP | 80.4 | 760 | 9.5 | 8.3 |
| AC52 | AF576 | GFP | 78.3 | 526 | 6.7 | 7.6 |
| AC398 | AE288 | FVII | 76.3 | 650 | 8.5 | 8.2 |
| AC404 | AE864 | FVII | 129 | 1900 | 14.7 | 10.1 |
| AC85 | AE864 | Exendin-4 | 83.6 | 938 | 11.2 | 8.9 |
| AC114 | AM875 | Exendin-4 | 82.4 | 1344 | 16.3 | 9.4 |
| AC143 | AM875 | hGH | 100.6 | 846 | 8.4 | 8.7 |
| AC302 | AE912 + AE144 | hGH | 119.1 | 2,287 | 19.2 | 11.0 |
| AC227 | AM875 | IL-1ra | 95.4 | 1103 | 11.6 | 9.2 |
| AC228 | AM1318 | IL-1ra | 134.8 | 2286 | 17.0 | 10.5 |
| AC493 | AE864 | FIX | 127.7* | 3967 | 31.1 | 12.2 |
| AC616 | AE864 | GLP2-2G | 83.1 | 1427 | 17.2 | 10 |
| AC647 | AE864 | Ghrelin | 82.7 | 996 | 12 | 9.2 |
| AC659 | AE864 | C-peptide | 82.7 | 822 | 10 | 8.8 |
| AC663 | AE1296 | C-peptide | 122.2 | 2348 | 19.2 | 11.1 |
| AC434 | AE288 | aaT | 71.1 | 500 | 7.0 | 7.7 |
| AC435 | AE576 | aaT | 97.5 | 1,127 | 11.6 | 9.5 |
| AC345 | AM875 | aaT | 122.6 | 1,390 | 11.3 | 9.9 |
| AC450 | AE288 | aHer2_scFv | 56.2 | 312 | 5.5 | |
| AC451 | AE576 | aHer2_scFv | 82.6 | 760 | 9.2 | 8.6 |
| AC452 | AE864 | aHer2_scFv | 109.1 | 1,390 | 12.7 | 9.9 |

*excluding glycosylation

Example 59: Analysis of Sequences for Secondary Structure by Prediction Algorithms Amino acid sequences can be assessed for secondary structure via certain computer programs or algorithms, such as the well-known Chou-Fasman algorithm (Chou, P. Y., et al. (1974) Biochemistry, 13: 222-45) and the Garnier-Osguthorpe-Robson, or "GOR" method (Garnier J, Gibrat J F, Robson B. (1996). GOR method for predicting protein secondary structure from amino acid sequence. Methods Enzymol 266:540-553). For a given sequence, the algorithms can predict whether there exists some or no secondary structure at all, expressed as total and/or percentage of residues of the sequence that form, for example, alpha-helices or beta-sheets or the percentage of residues of the sequence predicted to result in random coil formation.

Several representative sequences from XTEN "families" have been assessed using two algorithm tools for the Chou-Fasman and GOR methods to assess the degree of secondary structure in these sequences. The Chou-Fasman tool was provided by William R. Pearson and the University of Virginia, at the "Biosupport" internet site, URL located on the World Wide Web at .fasta.bioch.virginia.edu/fasta_www2/fasta_www.cgi?rm=misc1 as it existed on Jun. 19, 2009. The GOR tool was provided by Pole Informatique Lyonnais at the Network Protein Sequence Analysis internet site, URL located on the World Wide Web at .npsa-pbil.ibcp.fr/cgi-bin/secpred_gor4.pl as it existed on Jun. 19, 2008.

As a first step in the analyses, a single XTEN sequence was analyzed by the two algorithms. The AE864 composition is a XTEN with 864 amino acid residues created from multiple copies of four 12 amino acid sequence motifs consisting of the amino acids G, S, T, E, P, and A. The sequence motifs are characterized by the fact that there is limited repetitiveness within the motifs and within the overall sequence in that the sequence of any two consecutive amino acids is not repeated more than twice in any one 12 amino acid motif, and that no three contiguous amino acids of full-length the XTEN are identical. Successively longer portions of the AF 864 sequence from the N-terminus were analyzed by the Chou-Fasman and GOR algorithms (the latter requires a minimum length of 17 amino acids). The sequences were analyzed by entering the FASTA format sequences into the prediction tools and running the analysis. The results from the analyses are presented in Table 45.

The results indicate that, by the Chou-Fasman calculations, short XTEN of the AE and AG families, up to at least 288 amino acid residues, have no alpha-helices or beta sheets, but amounts of predicted percentage of random coil by the GOR algorithm vary from 78-99%. With increasing XTEN lengths of 504 residues to greater than 1300, the XTEN analyzed by the Chou-Fasman algorithm had predicted percentages of alpha-helices or beta sheets of 0 to about 2%, while the calculated percentages of random coil increased to from 94-99%. Those XTEN with alpha-helices or beta sheets were those sequences with one or more instances of three contiguous serine residues, which resulted in predicted beta-sheet formation. However, even these sequences still had approximately 99% random coil formation.

The analysis supports the conclusion that: 1) XTEN created from multiple sequence motifs of G, S, T, E, P, and A that have limited repetitiveness as to contiguous amino acids are predicted to have very low amounts of alpha-helices and beta-sheets; 2) that increasing the length of the XTEN does not appreciably increase the probability of alpha-helix or beta-sheet formation; and 3) that progressively increasing the length of the XTEN sequence by addition of non-repetitive 12-mers consisting of the amino acids G, S, T, E, P, and A results in increased percentage of random coil formation. Based on the numerous sequences evaluated by these methods, it is concluded that XTEN created from sequence motifs of G, S, T, E, P, and A that have limited repetitiveness (defined as no more than two identical contiguous amino acids in any one motif) are expected to have very limited secondary structure. With the exception of motifs containing three contiguous serines, generally any order or combination of sequence motifs from Table 1 can be used to create an XTEN polypeptide that will result in an XTEN sequence that is substantially devoid of secondary structure, and that the effects of three contiguous serines is ameliorated by increasing the length of the XTEN. Such sequences are expected to have the characteristics described in the XTEN-containing composition embodiments of the invention disclosed herein.

TABLE 45

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| AE36: LCW0402_002 | GSPAGSPTSTEEGTSESATPESGPGTST EPSEGSAP | 1103 | 36 | Residue totals: H: 0 E: 0 percent: H: 0.0 E: 0.0 | 94.44% |
| AE36: LCW0402_003 | GTSTEPSEGSAPGTSTEPSEGSAPGTST EPSEGSAP | 1104 | 36 | Residue totals: H: 0 E: 0 percent: H: 0.0 E: 0.0 | 94.44% |
| AG36: LCW0404_001 | GASPGTSSTGSPGTPGSGTASSSPGSST PSGATGSP | 1105 | 36 | Residue totals: H: 0 E: 0 percent: H: 0.0 E: 0.0 | 77.78% |
| AG36: LCW0404_003 | GSSTPSGATGSPGSSPSASTGTGPGSST PSGATGSP | 1106 | 36 | Residue totals: H: 0 E: 0 percent: H: 0.0 E: 0.0 | 83.33% |
| AE42_1 | TEPSEGSAPGSPAGSPTSTEEGTSESAT PESGPGSEPATSGS | 1107 | 42 | Residue totals: H: 0 E: 0 percent: H: 0.0 E: 0.0 | 90.48% |
| AE42_1 | TEPSEGSAPGSPAGSPTSTEEGTSESAT PESGPGSEPATSGS | 1108 | 42 | Residue totals: H: 0 E: 0 percent: H: 0.0 E: 0.0 | 90.48% |
| AG42_1 | GAPSPSASTGTGPGTPGSGTASSSPGS STPSGATGSPGPSGP | 1109 | 42 | Residue totals: H: 0 E: 0 percent: H: 0.0 E: 0.0 | 88.10% |
| AG42_2 | GPGTPGSGTASSSPGSSTPSGATGSPG SSPSASTGTGPGASP | 1110 | 42 | Residue totals: H: 0 E: 0 percent: H: 0.0 E: 0.0 | 88.10% |
| AE144 | GSEPATSGSETPGTSESATPESGPGSEP ATSGSETPGSPAGSPTSTEEGTSTEPSE GSAPGSEPATSGSETPGSEPATSGSETP GSEPATSGSETPGTSTEPSEGSAPGTSE SATPESGPGSEPATSGSETPGTSTEPSE GSAP | 1111 | 144 | Residue totals: H: 0 E: 0 percent: H: 0.0 E: 0.0 | 98.61% |
| AG144_1 | PGSSPSASTGTGPGSSPSASTGTGPGTP GSGTASSSPGSSTPSGATGSPGSSPSAS TGTGPGASPGTSSTGSPGTPGSGTASS SPGSSTPSGATGSPGTPGSGTASSSPG ASPGTSSTGSPGASPGTSSTGSPGTPGS GTASSS | 1112 | 144 | Residue totals: H: 0 E: 0 percent: H: 0.0 E: 0.0 | 91.67% |
| AE288 | GTSESATPESGPGSEPATSGSETPGTSE SATPESGPGSEPATSGSETPGTSESATP ESGPGTSTEPSEGSAPGSPAGSPTSTEE GTSESATPESGPGSEPATSGSETPGTSE SATPESGPGSPAGSPTSTEEGSPAGSPT STEEGTSTEPSEGSAPGTSESATPESGP GTSESATPESGPGTSESATPESGPGSEP ATSGSETPGSEPATSGSETPGSPAGSPT STEEGTSTEPSEGSAPGTSTEPSEGSAP GSEPATSGSETPGTSESATPESGPGTST EPSEGSAP | 1113 | 288 | Residue totals: H: 0 E: 0 percent: H: 0.0 E: 0.0 | 99.31% |
| AG288_2 | GSSPSASTGTGPGSSPSASTGTGPGTP GSGTASSSPGSSTPSGATGSPGSSPSAS TGTGPGASPGTSSTGSPGTPGSGTASS SPGSSTPSGATGSPGTPGSGTASSSPG ASPGTSSTGSPGASPGTSSTGSPGTPGS GTASSSPGSSTPSGATGSPGASPGTSST | 1114 | 288 | Residue totals: H: 0 E: 0 percent: H: 0.0 E: 0.0 | 92.71 |

TABLE 45-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | GSPGTPGSGTASSSPGSSTPSGATGSP GSSPSASTGTGPGSSPSASTGTGPGSST PSGATGSPGSSTPSGATGSPGASPGTS STGSPGASPGTSSTGSPGASPGTSSTGS PGTPGSGTASSSP | | | | |
| AF504 | GASPGTSSTGSPGSSPSASTGTGPGSSP SASTGTGPGTPGSGTASSSPGSSTPSG ATGSPGSNPSASTGTGPGASPGTSSTG SPGTPGSGTASSSPGSSTPSGATGSPGT PGSGTASSSPGASPGTSSTGSPGASPG TSSTGSPGTPGSGTASSSPGSSTPSGAT GSPGASPGTSSTGSPGTPGSGTASSSP GSSTPSGATGSPGSNPSASTGTGPGSS PSASTGTGPGSSTPSGATGSPGSSTPSG ATGSPGASPGTSSTGSPGASPGTSSTG SPGASPGTSSTGSPGTPGSGTASSSPG ASPGTSSTGSPGASPGTSSTGSPGASP GTSSTGSPGSSPSASTGTGPGTPGSGT ASSSPGASPGTSSTGSPGASPGTSSTGS PGASPGTSSTGSPGSSTPSGATGSPGSS TPSGATGSPGASPGTSSTGSPGTPGSG TASSSPGSSTPSGATGSPGSSTPSGATG SPGSSTPSGATGSPGSSPSASTGTGPG ASPGTSSTGSP | 1115 | 504 | Residue totals: H: 0 E: 0 percent: H: 0.0 E: 0.0 | 94.44% |
| AD 576 | GSSESGSSEGGPGSGGEPSESGSSGSSE SGSSEGGPGSSESGSSEGGPGSSESGSS EGGPGSSESGSSEGGPGSSESGSSEGG PGESPGGSSGSESGSEGSSGPGESSGSS ESGSSEGGPGSSESGSSEGGPGSSESGS SEGGPGSGGEPSESGSSGESPGGSSGS ESGESPGGSSGSESGSGGEPSESGSSGS SESGSSEGGPGSGGEPSESGSSGSGGE PSESGSSGSEGSSGPGESSGESPGGSSG SESGSGGEPSESGSSGSGGEPSESGSSG SGGEPSESGSSGSSESGSSEGGPGESPG GSSGSESGESPGGSSGSESGESPGGSS GSESGESPGGSSGSESGESPGGSSGSES GSSESGSSEGGPGSGGEPSESGSSGSE GSSGPGESSGSSESGSSEGGPGSGGEP SESGSSGSSESGSSEGGPGSGGEPSESG SSGESPGGSSGSESGESPGGSSGSESGS SESGSSEGGPGSGGEPSESGSSGSSESG SSEGGPGSGGEPSESGSSGSSGGEPSES GSSGESPGGSSGSESGSEGSSGPGESS GSSESGSSEGGPGSEGSSGPGESS | 1116 | 576 | Residue totals: H: 7 E: 0 percent: H: 1.2 E: 0.0 | 99.65% |
| AE576 | GSPAGSPTSTEEGTSESATPESGPGTST EPSEGSAPGSPAGSPTSTEEGTSTEPSE GSAPGTSTEPSEGSAPGTSESATPESGP GSEPATSGSETPGSEPATSGSETPGSPA GSPTSTEEGTSESATPESGPGTSTEPSE GSAPGTSTEPSEGSAPGSPAGSPTSTEE GTSTEPSEGSAPGTSTEPSEGSAPGTSE SATPESGPGTSTEPSEGSAPGTSESATP ESGPGSEPATSGSETPGTSTEPSEGSAP GTSTEPSEGSAPGTSESATPESGPGTSE SATPESGPGSPAGSPTSTEEGTSESATP ESGPGSEPATSGSETPGTSESATPESGP GTSTEPSEGSAPGTSTEPSEGSAPGTST EPSEGSAPGTSTEPSEGSAPGTSTEPSE GSAPGTSTEPSEGSAPGSPAGSPTSTEE GTSTEPSEGSAPGTSESATPESGPGSEP ATSGSETPGTSESATPESGPGSEPATS GSETPGTSESATPESGPGTSTEPSEGSA PGTSESATPESGPGSPAGSPTSTEEGSP AGSPTSTEEGSPAGSPTSTEEGTSESAT PESGPGTSTEPSEGSAP | 1117 | 576 | Residue totals: H: 2 E: 0 percent: H: 0.4 E: 0.0 | 99.65% |
| AG576 | PGTPGSGTASSSPGSSTPSGATGSPGSS PSASTGTGPGSSPSASTGTGPGSSTPSG ATGSPGSSTPSGATGSPGASPGTSSTG SPGASPGTSSTGSPGASPGTSSTGSPGT PGSGTASSSPGASPGTSSTGSPGASPG | 1118 | 576 | Residue totals: H: 0 E: 3 percent: H: 0.4 E: 0.5 | 99.31% |

TABLE 45-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | TSSTGSPGASPGTSSTGSPGSSPSASTG TGPGTPGSTASSSPGASPGTSSTGSP GASPGTSSTGSPGASPGTSSTGSPGSST PSGATGSPGSSTPSGATGSPGASPGTS STGSPGTPGSTASSSPGSSTPSGATGS PGSSTPSGATGSPGSSTPSGATGSPGSS PSASTGTGPGASPGTSSTGSPGASPGT SSTGSPGTPGSGTASSSPGASPGTSSTG SPGASPGTSSTGSPGASPGTSSTGSPG ASPGTSSTGSPGTPGSGTASSSPGSSTP SGATGSPGTPGSGTASSSPGSSTPSGA TGSPGTPGSGTASSSPGSSTPSGATGSP GSSTPSGATGSPGSSPSASTGTGPGSSP SASTGTGPGASPGTSSTGSPGTPGSGT ASSSPGSSTPSGATGSPGSSPSASTGTG PGSSPSASTGTGPGASPGTSSTGS | | | | |
| AF540 | GSTSSTAESPGPGSTSSTAESPGPGSTS ESPSGTAPGSTSSTAESPGPGSTSSTAE SPGPGTSTPESGSASPGSTSESPSGTAP GTSPSGESSTAPGSTSESPSGTAPGSTS ESPSGTAPGTSPSGESSTAPGSTSESPS GTAPGSTSESPSGTAPGTSPSGESSTAP GSTSESPSGTAPGSTSESPSGTAPGSTS ESPSGTAPGTSTPESGSASPGSTSESPS GTAPGTSTPESGSASPGSTSSTAESPGP GSTSSTAESPGPGTSTPESGSASPGTST PESGSASPGTSESPSGTAPGTSTPESG SASPGTSTPESGSASPGSTSESPSGTAP GSTSESPSGTAPGSTSESPSGTAPGSTS STAESPGPGTSTPESGSASPGTSTPESG SASPGSTSESPSGTAPGSTSESPSGTAP GTSTPESGSASPGSTSESPSGTAPGSTS ESPSGTAPGTSTPESGSASPGTSPSGES STAPGSTSSTAESPGPGTSTPSGESSTAP GSTSSTAESPGPGTSTPESGSASPGSTS ESPSGTAP | 1119 | 540 | Residue totals: H: 2 E: 0 percent: H: 0.4 E: 0.0 | 99.65 |
| AD836 | GSSESGSSEGGPGSSESGSSEGGPGESP GGSSGSESGSGGEPSESGSSGESPGGS SGESGESPGGSSGSESGSSESGSSEGG PGSSESGSSEGGPGSSESGSSEGGPGES PGGSSGSESGESPGGSSGSESGESPGG SSGSESGSSESGSSEGGPGSSESGSSEG GPGSSESGSSEGGPGSSESGSSEGGPG SSESGSSEGGPGSSESGSSEGGPGSGG EPSESGSSGESPGGSSGSESGESPGGSS GSESGSGGEPSESGSSGSEGSSGPGESS GSSESGSSEGGPGSGGEPSESGSSGSE GSSGPGESSGSSESGSSEGGPGSGGEP SESGSSGESPGGSSGSESGSGGEPSESG SSGSGGEPSESGSSGSSESGSSEGGPGS GGEPSESGSSGSGGEPSESGSSGSEGSS GPGESSGESPGGSSGSESGSEGSSGPG ESSGSEGSSGPGESSGSGGGEPSESGSSG SSESGSSEGGPGSSESGSSEGGPGESPG GSSGSESGSGGEPSESGSSGSEGSSGP GESSGESPGGSSGSESGSEGSSGPGSSE SGSSEGGPGSGGEPSESGSSGSEGSSG PGESSGSEGSSGPGESSGSEGSSGPGES SGSGGEPSESGSSGSGGEPSESGSSGES PGGSSGSESGESPGGSSGSESGSGGEP SESGSGSEGSSGPGESSGESPGGSSGS ESGSSESGSSEGGPGSSESGSSEGGPGS SESGSSEGGPGSGGEPSESGSSGSSESG SSEGGPGESPGGSSGSESGSGGEPSES GSSGSSESGSSEGGPGESPGGSSGSES GSGGEPSESGSSGESPGGSSGSESGSG GEPSESGSS | 1120 | 836 | Residue totals: H: 0 E: 0 percent: H: 0.0 E: 0.0 | 98.44% |
| AE864 | GSPAGSPTSTEEGTSESATPESGPGTST EPSEGSAPGSPAGSPTSTEEGTSTEPSE GSAPGTSTEPSEGSAPGTSESATPESGP GSEPATSGSETPGSEPATSGSETPGSPA GSPTSTEEGTSESATPESGPGTSTEPSE | 1121 | 864 | Residue totals: H: 2 E: 3 percent: H: 0.2 E: 0.4 | 99.77% |

TABLE 45-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | GSAPGTSTEPSEGSAPGSPAGSPTSTEE GTSTEPSEGSAPGTSTEPSEGSAPGTSE SATPESGPGTSTEPSEGSAPGTSESATP ESGPGSEPATSGSETPGTSTEPSEGSAP GTSTEPSEGSAPGTSESATPESGPGTSE SATPESGPGSPAGSPTSTEEGTSESATP ESGPGSEPATSGSETPGTSESATPESGP GTSTEPSEGSAPGTSTEPSEGSAPGTST EPSEGSAPGTSTEPSEGSAPGTSTEPSE GSAPGTSTEPSEGSAPGSPAGSPTSTEE GTSTEPSEGSAPGTSESATPESGPGSEP ATSGSETPGTSESATPESGPGSEPATS GSETPGTSESATPESGPGTSTEPSEGSA PGTSESATPESGPGSPAGSPTSTEEGSP AGSPTSTEEGSPAGSPTSTEEGTSESAT PESGPGTSTEPSEGSAPGTSESATPESG PGSEPATSGSETPGTSESATPESGPGSE PATSGSETPGTSESATPESGPGTSTEPS EGSAPGSPAGSPTSTEEGTSESATPES GPGSEPATSGSETPGTSESATPESGPGS PAGSPTSTEEGSPAGSPTSTEEGTSTEP SEGSAPGTSESATPESGPGTSESATPES GPGTSESATPESGPGSEPATSGSETPGS EPATSGSETPGSPAGSPTSTEEGTSTEP SEGSAPGTSTEPSEGSAPGSEPATSGSE TPGTSESATPESGPGTSTEPSEGSAP | | | | |
| AF864 | GSTSESPSGTAPGTSPSGESSTAPGSTS ESPSGTAPGSTSESPSGTAPGTSTPESG SASPGTSTPESGSASPGSTSESPSGTAP GSTSESPSGTAPGTSPSGESSTAPGSTS ESPSGTAPGTSPSGESSTAPGTSPSGES STAPGSTSSTAESPGPGTSPSGESSTAP GTSPSGESSTAPGSTSSTAESPGPGTST PESGSASPGTSTPESGSASPGSTSESPS GTAPGSTSESPSGTAPGTSTPESGSASP GSTSSTAESPGPGTSTPESGSASPGSTS ESPSGTAPGTSPSGESSTAPGSTSSTAE SPGPGTSPSGESSTAPGTSTPESGSASP GSTSSTAESPGPGTSSTAESPGPGSTS STAESPGPGTSSTAESPGPGTSPSGES STAPGSTSESPSGTAPGSTSESPSGTAP GTSTPESGPXXXGASASGAPSTXXXX SESPSGTAPGSTSESPSGTAPGSTSESP SGTAPGSTSESPSGTAPGSTSESPSGTA PGSTSESPSGTAPGTSTPESGSASPGTS PSGESSTAPGTSPSGESSTAPGSTSSTA ESPGPGTSPSGESSTAPGTSTPESGSAS PGSTSESPSGTAPGSTSESPSGTAPGTS PSGESSTAPGSTSESPSGTAPGTSTPES GSASPGTSTPESGSASPGSTSESPSGTA PGTSTPESGSASPGSTSSTAESPGPGST SESPSGTAPGSTSESPSGTAPGTSPSGE SSTAPGSTSSTAESPGPGTSPSGESSTA PGTSTPESGSASPGTSPSGESSTAPGTS PSGESSTAPGTSPSGESSTAPGSTSSTA ESPGPGTSSTAESPGPGTSPSGESSTA PGSSPSASTGTGPGSSTPSGATGSPGSS TPSGATGSP | 1122 | 875 | Residue totals: H: 2 E: 0 percent: H: 0.2 E: 0.0 | 95.20% |
| AG864 | GASPGTSSTGSPGSSPSASTGTGPGSSP SASTGTGPGTPGSGTASSSPGSSTPSG ATGSPGSSPSASTGTGPGASPGTSSTG SPGTPGSGTASSSPGSSTPSGATGSPGT PGSGTASSSPGASPGTSSTGSPGASPG TSSTGSPGTPGSGTASSSPGSSTPSGAT GSPGASPGTSSTGSPGTPGSGTASSSP GSSTPSGATGSPGSSPSASTGTGPGSSP SASTGTGPGSSTPSGATGSPGSSTPSG ATGSPGASPGTSSTGSPGASPGTSSTG SPGASPGTSSTGSPGTPGSGTASSSPG ASPGTSSTGSPGASPGTSSTGSPGASP GTSSTGSPGSSPSASTGTGPGTPGSGT ASSSPGASPGTSSTGSPGASPGTSSTGS PGASPGTSSTGSPGSSTPSGATGSPGSS | 1123 | 864 | Residue totals: H: 0 E: 0 percent: H: 0.0 E: 0.0 | 94.91% |

TABLE 45-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | TPSGATGSPGASPGTSSTGSPGTPGSG TASSSPGSSTPSGATGSPGSSTPSGATG SPGSSTPSGATGSPGSSPSASTGTGPG ASPGTSSTGSPGASPGTSSTGSPGTPGS GTASSSPGASPGTSSTGSPGASPGTSST GSPGASPGTSSTGSPGASPGTSSTGSP GTPGSGTASSSPGSSTPSGATGSPGTP GSGTASSSPGSSTPSGATGSPGTPGSG TASSSPGSSTPSGATGSPGSSTPSGATG SPGSSPSASTGTGPGSSPSASTGTGPG ASPGTSSTGSPGTPGSGTASSSPGSSTP SGATGSPGSSPSASTGTGPGSSPSAST GTGPGASPGTSSTGSPGASPGTSSTGS PGSSTPSGATGSPGSSPSASTGTGPGA SPGTSSTGSPGSSPSASTGTGPGTPGSG TASSSPGSSTPSGATGSPGSSTPSGATG SPGASPGTSSTGSP | | | | |
| AM875 | GTSTEPSEGSAPGSEPATSGSETPGSPA GSPTSTEEGSTSSTAESPGPGTSTPESG SASPGSTSESPSGTAPGSTSESPSGTAP GTSTPESGSASPGTSTPESGSASPGSEP ATSGSETPGTSESATPESGPGSPAGSPT STEEGTSTEPSEGSAPGTSESATPESGP GTSTEPSEGSAPGTSTEPSEGSAPGSPA GSPTSTEEGTSTEPSEGSAPGTSTEPSE GSAPGTSESATPESGPGTSESATPESGP GTSTEPSEGSAPGTSTEPSEGSAPGTSE SATPESGPGTSTEPSEGSAPGSEPATSG SETPGSPAGSPTSTEEGSSTPSGATGSP GTPGSGTASSSPGSSTPSGATGSPGTS TEPSEGSAPGTSTEPSEGSAPGSEPATS GSETPGSPAGSPTSTEEGSPAGSPTSTE EGTSTEPSEGSAPGASASGAPSTGGTS ESATPESGPGSPAGSPTSTEEGSPAGSP TSTEEGSTSSTAESPGPGSTSESPSGTA PGTSPSGESSTAPGTPGSGTASSSPGSS TPSGATGSPGSSPSASTGTGPGSEPAT SGSETPGTSESATPESGPGSEPATSGSE TPGSTSSTAESPGPGSTSSTAESPGPGT SPSGESSTAPGSEPATSGSETPGSEPAT SGSETPGTSTEPSEGSAPGSTSSTAESP GPGTSTPESGSASPGSTSESPSGTAPGT STEPSEGSAPGTSTEPSEGSAPGTSTEP SEGSAPGSSTPSGATGSPGSSPSASTGT GPGASPGTSSTGSPGSEPATSGSETPG TSESATPESGPGSPAGSPTSTEEGSSTP SGATGSPGSSPSASTGTGPGASPGTSS TGSPGTSESATPESGPGTSTEPSEGSAP GTSTEPSEGSAP | 1124 | 875 | Residue totals: H: 7 E: 3 percent: H: 0.8 E: 0.3 | 98.63% |
| AM1318 | GTSTEPSEGSAPGSEPATSGSETPGSPA GSPTSTEEGSTSSTAESPGPGTSTPESG SASPGSTSESPSGTAPGSTSESPSGTAP GTSTPESGSASPGTSTPESGSASPGSEP ATSGSETPGTSESATPESGPGSPAGSPT STEEGTSTEPSEGSAPGTSESATPESGP GTSTEPSEGSAPGTSTEPSEGSAPGSPA GSPTSTEEGTSTEPSEGSAPGTSTEPSE GSAPGTSESATPESGPGTSESATPESGP GTSTEPSEGSAPGTSTEPSEGSAPGTSE SATPESGPGTSTEPSEGSAPGSEPATSG SETPGSPAGSPTSTEEGSSTPSGATGSP GTPGSGTASSSPGSSTPSGATGSPGTS TEPSEGSAPGTSTEPSEGSAPGSEPATS GSETPGSPAGSPTSTEEGSPAGSPTSTE EGTSTEPSEGSAPGPEPTGPAPSGGSEP ATSGSETPGTSESATPESGPGSPAGSPT STEEGTSESATPESGPGSPAGSPTSTEE GSPAGSPTSTEEGTSESATPESGPGSPA GSPTSTEEGSPAGSPTSTEEGSTSSTAE SPGPGSTSESPSGTAPGTSPSGESSTAP GSTSESPSGTAPGSTSESPSGTAPGTSP SGESSTAPGTSTEPSEGSAPGTSESATP ESGPGTSESATPESGPGSEPATSGSETP | 1125 | 1318 | Residue totals: H: 7 E: 0 percent: H: 0.7 E: 0.0 | 99.17% |

TABLE 45-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | GTSESATPESGPGTSESATPESGPGTST EPSEGSAPGTSESATPESGPGTSTEPSE GSAPGTSPSGESSTAPGTSPSGESSTAP GTSPSGESSTAPGTSTEPSEGSAPGSPA GSPTSTEEGTSTEPSEGSAPGSSPSAST GTGPGSSTPSGATGSPGSSTPSGATGS PGSSTPSGATGSPGSSTPSGATGSPGA SPGTSSTGSPGASASGAPSTGGTSPSG ESSTAPGSTSSTAESPGPGTSPSGESST APGTSESATPESGPGTSTEPSEGSAPG TSTEPSEGSAPGSSPSASTGTGPGSSTP SGATGSPGASPGTSSTGSPGTSTPESG SASPGTSPSGESSTAPGTSPSGESSTAP GTSESATPESGPGSEPATSGSETPGTST EPSEGSAPGSTSESPSGTAPGSTSESPS GTAPGTSTPESGSASPGSPAGSPTSTEE GTSESATPESGPGTSTEPSEGSAPGSPA GSPTSTEEGTSESATPESGPGSEPATSG SETPGSSTPSGATGSPGASPGTSSTGSP GSSTPSGATGSPGSTSESPSGTAPGTSP SGESSTAPGSTSSTAESPGPGSSTPSGA TGSPGASPGTSSTGSPGTPGSGTASSSP GSPAGSPTSTEEGSPAGSPTSTEEGTST EPSEGSAP | | | | |
| AM923 | MAEPAGSPTSTEEGASPGTSSTGSPGS STPSGATGSPGSSTPSGATGSPGTSTEP SEGSAPGSEPATSGSETPGSPAGSPTST EEGSTSSTAESPGPGTSTPESGSASPGS TSESPSGTAPGSTSESPSGTAPGTSTPE SGSASPGTSTPESGSASPGSEPATSGSE TPGTSESATPESGPGSPAGSPTSTEEGT STEPSEGSAPGTSESATPESGPGTSTEP SEGSAPGTSTEPSEGSAPGSPAGSPTST EEGTSTEPSEGSAPGTSTEPSEGSAPGT SESATPESGPGTSESATPESGPGTSTEP SEGSAPGTSTEPSEGSAPGTSESATPES GPGTSTEPSEGSAPGSEPATSGSETPGS PAGSPTSTEEGSSTPSGATGSPGTPGS GTASSSPGSSTPSGATGSPGTSTEPSEG SAPGTSTEPSEGSAPGSEPATSGSETPG SPAGSPTSTEEGSPAGSPTSTEEGTSTE PSEGSAPGASASGAPSTGGTSESATPE SGPGSPAGSPTSTEEGSPAGSPTSTEEG STSSTAESPGPGTSESPSGTAPGTSPS GESSTAPGTPGSGTASSSPGSSTPSGA TGSPGSSPSASTGTGPGSEPATSGSETP GTSESATPESGPGSEPATSGSETPGSTS STAESPGPGSTSSTAESPGPGTSPSGES STAPGSEPATSGSETPGSEPATSGSETP GTSTEPSEGSAPGSTSSTAESPGPGTST PESGSASPGSTSESPSGTAPGTSTEPSE GSAPGTSTEPSEGSAPGTSTEPSEGSAP GSSTPSGATGSPGSSPSASTGTGPGAS PGTSSTGSPGSEPATSGSETPGTSESAT PESGPGSPAGSPTSTEEGSSTPSGATGS PGSSPSASTGTGPGASPGTSSTGSPGTS ESATPESGPGTSTEPSEGSAPGTSTEPS EGSAP | 1126 | 924 | Residue totals: H: 4 E: 3 percent: H: 0.4 E: 0.3 | 98.70% |
| AE912 | MAEPAGSPTSTEEGTPGSGTASSSPGS STPSGATGSPGASPGTSSTGSPGSPAG SPTSTEEGTSESATPESGPGTSTEPSEG SAPGSPAGSPTSTEEGTSTEPSEGSAPG TSTEPSEGSAPGTSESATPESGPGSEPA TSGSETPGSEPATSGSETPGSPAGSPTS TEEGTSESATPESGPGTSTEPSEGSAPG TSTEPSEGSAPGSPAGSPTSTEEGTSTE PSEGSAPGTSTEPSEGSAPGTSESATPE SGPGTSTEPSEGSAPGTSESATPESGPG SEPATSGSETPGTSTEPSEGSAPGTSTE PSEGSAPGTSESATPESGPGTSESATPE SGPGSPAGSPTSTEEGTSESATPESGPG SEPATSGSETPGTSESATPESGPGTSTE PSEGSAPGTSTEPSEGSAPGTSTEPSEG | 1127 | 913 | Residue totals: H: 8 E: 3 percent: H: 0.9 E: 0.3 | 99.45% |

TABLE 45-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | SAPGTSTEPSEGSAPGTSTEPSEGSAPG TSTEPSEGSAPGSPAGSPTSTEEGTSTE PSEGSAPGTSESATPESGPGSEPATSGS ETPGTSESATPESGPGSEPATSGSETPG TSESATPESGPGTSTEPSEGSAPGTSES ATPESGPGSPAGSPTSTEEGSPAGSPTS TEEGSPAGSPTSTEEGTSESATPESGPG TSTEPSEGSAPGTSESATPESGPGSEPA TSGSETPGTSESATPESGPGSEPATSGS ETPGTSESATPESGPGTSTEPSEGSAPG SPAGSPTSTEEGTSESATPESGPGSEPA TSGSETPGTSESATPESGPGSPAGSPTS TEEGSPAGSPTSTEEGTSTEPSEGSAPG TSESATPESGPGTSESATPESGPGTSES ATPESGPGSEPATSGSETPGSEPATSGS ETPGSPAGSPTSTEEGTSTEPSEGSAPG TSTEPSEGSAPGSEPATSGSETPGTSES ATPESGPGTSTEPSEGSAP | | | | |
| BC 864 | GTSTEPSEPGSAGTSTEPSEPGSAGSEP ATSGTEPSGSGASEPTSTEPGSEPATS GTEPSGSEPATSGTEPSGSEPATSGTEP SGSGASEPTSTEPGTSTEPSEPGSAGSE PATSGTEPSGTSTEPSEPGSAGSEPATS GTEPSGSEPATSGTEPSGTSTEPSEPGS AGTSTEPSEPGSAGSEPATSGTEPSGS EPATSGTEPSGTSEPSTSEPGAGSGAS EPTSTEPGTSEPSTSEPGAGSEPATSGT EPSGSEPATSGTEPSGTSTEPSEPGSAG TSTEPSEPGSAGSGASEPTSTEPGSEPA TSGTEPSGSEPATSGTEPSGSEPATSGT EPSGSEPATSGTEPSGTSTEPSEPGSAG SEPATSGTEPSGSGASEPTSTEPGTSTE PSEPGSAGSEPATSGTEPSGSGASEPTS TEPGTSTEPSEPGSAGSGASEPTSTEPG SEPATSGTEPSGSGASEPTSTEPGSEPA TSGTEPSGSGASEPTSTEPGTSTEPSEP GSAGSEPATSGTEPSGSGASEPTSTEP GTSTEPSEPGSAGSEPATSGTEPSGTST EPSEPGSAGSEPATSGTEPSGTSTEPSE PGSAGTSTEPSEPGSAGTSTEPSEPGSA GTSTEPSEPGSAGTSTEPSEPGSAGTST EPSEPGSAGTSEPSTSEPGAGSGASEPT STEPGTSTEPSEPGSAGTSTEPSEPGSA GTSTEPSEPGSAGSEPATSGTEPSGSG ASEPTSTEPGSEPATSGTEPSGSEPATS GTEPSGSEPATSGTEPSGSEPATSGTEP SGTSEPSTSEPGAGSEPATSGTEPSGSG ASEPTSTEPGTSTEPSEPGSAGSEPATS GTEPSGSGASEPTSTEPGTSTEPSEPGS A | 1128 | | Residue totals: H: 0 E: 0 percent: H: 0 E: 0 | 99.77% |

\* H: alpha-helix E: beta-sheet

Example 60: Analysis of Polypeptide Sequences for Repetitiveness

Polypeptide amino acid sequences can be assessed for repetitiveness by quantifying the number of times a shorter subsequence appears within the overall polypeptide. For example, a polypeptide of 200 amino acid residues has 192 overlapping 9-amino acid subsequences (or 9-mer "frames"), but the number of unique 9-mer subsequences will depend on the amount of repetitiveness within the sequence. In the present analysis, different sequences were assessed for repetitiveness by summing the occurrence of all unique 3-mer subsequences for each 3-amino acid frame across the first 200 amino acids of the polymer portion divided by the absolute number of unique 3-mer subsequences within the 200 amino acid sequence. The resulting subsequence score is a reflection of the degree of repetitiveness within the polypeptide.

The results, shown in Table 46, indicate that the unstructured polypeptides consisting of 2 or 3 amino acid types have high subsequence scores, while those of consisting of 12 amino acids motifs of the six amino acids G, S, T, E, P, and A with a low degree of internal repetitiveness, have subsequence scores of less than 10, and in some cases, less than 5. For example, the L288 sequence has two amino acid types and has short, highly repetitive sequences, resulting in a subsequence score of 50.0. The polypeptide J288 has three amino acid types but also has short, repetitive sequences, resulting in a subsequence score of 33.3. Y576 also has three amino acid types, but is not made of internal repeats, reflected in the subsequence score of 15.7 over the first 200 amino acids. W576 consists of four types of amino acids, but has a higher degree of internal repetitiveness, e.g., "GGSG" (SEQ ID NO: 1129), resulting in a subsequence score of 23.4. The AD576 consists of four types of 12 amino acid motifs, each consisting of four types of amino acids. Because of the low degree of internal repetitiveness of the individual motifs, the overall subsequence score over the first 200 amino acids is 13.6. In contrast, XTEN's consisting of four motifs contains six types of amino acids, each with a low degree of internal repetitiveness have lower subsequence scores; i.e., AE864 (6.1), AF864 (7.5), and AM875 (4.5).

Conclusions:

The results indicate that the combination of 12 amino acid subsequence motifs, each consisting of four to six amino acid types that are essentially non-repetitive, into a longer XTEN polypeptide results in an overall sequence that is non-repetitive. This is despite the fact that each subsequence motif may be used multiple times across the sequence. In contrast, polymers created from smaller numbers of amino acid types resulted in higher subsequence scores, although the actual sequence can be tailored to reduce the degree of repetitiveness to result in lower subsequence scores.

TABLE 46

Subsequence score calculations of polypeptide sequences

| Seq Name | Amino Acid Sequence | SEQ ID NO: | Score |
|---|---|---|---|
| J288 | GSGGEGGSGGEGGSGGEGGSGGEGGSGGEGGSGGEGGSGGEGGSGGEGGS GGEGGSGGEGGSGGEGGSGGEGGSGGEGGSGGEGGSGGEGGSGGEGGSGG EGGSGGEGGSGGEGGSGGEGGSGGEGGSGGEGGSGGEGGSGGEGGSGGEG GSGGEGGSGGEGGSGGEGGSGGEGGSGGEGGSGGEGGSGGEGGSGGEGGS GGEGGSGGEGGSGGEGGSGGEGGSGGEGGSGGEGGSGGEGGSGGEGGSGG EGGSGGEGGSGGEGGSGGEGGSGGEGGSGGEGGSGGEG | 1130 | 33.3 |
| K288 | GEGEGGGEGGEGEGGGEGGGEGEGGGEGGEGEGGGEGGGEGEGGGEGGGE GGGEGGGEGEGGGEGGGEGEGGGEGGEGEGGGEGGGEGEGGGEGGEGGGE GGEGEGGGEGGEGEGGGEGGEGEGGGEGGEGEGGGEGGEGEGGGEGGGEG EGGGEGGEGEGGGEGGGEGEGGGEGGGEGEGGGEGGEGEGGGEGGGEGGG EGGEGEGGGEGGGEGEGGGEGGEGEGGGEGGGEGEGGGEGGGEGEGGGEGGE GEGGGEGGGEGEGGGEGGGEGEGGGEGGGEGEGGGEGGGEG | 1131 | 46.9 |
| L288 | SSESSSESSSSESSSESSESSSSESSSESSESSSSESSSESSESSSSESSSESSSSE SSSESSSESSSSESSSESSESSSSESSSESSESSSSESSSESSSSESSSESSESSSS ESSSESSESSSSESSSESSESSSSESSSESSESSSSESSSESSESSSSESSSESSSS SESSSESSESSSSESSSESSSESSSSESSSESSESSSSESSSESSESSSSESSESSS SSESSSESSESSSSESSSESSSESSSSESSSESSSESSSSESSSESSSESSSSSES | 1132 | 50.0 |
| Y288 | GEGSGEGSEGEGSEGSGEGEGSEGSGEGEGGSEGSEGEGGSEGEGEGGSEG SEGEGSGEGSEGEGGSEGSEGEGSGEGSEGEGSEGGSEGEGGSEGSEGEGSG EGSEGEGGEGGSEGEGSEGSGEGEGSGEGSEGEGSGEGSEGEGEGSEGSEG SEGSGEGEGSEGSGEGEGGSEGSEGEGSEGSGEGEGGEGSGEGEGSEGSEG EGGGEGSEGEGSGEGGEGEGSEGGSEGEGGSEGGEGEGSEGSGEGEGSEGG SEGEGSEGGSEGEGSEGSGEGEGSEGSGE | 1133 | 26.8 |
| Q576 | GGKPGEGGKPEGGGGKPGGKPEGEGEGKPGGKPEGGGKPGGGEGGKPEGG KPEGEGKPGGGEGKPGGKPEGGGGKPEGEGKPGGGGKPGGKPEGEGKPG GGEGGKPEGKPGEGGEGKPGGKPEGGGEGKPGGGKPGEGGKPGEGKPGGG EGGKPEGGKPEGEGKPGGGEGKPGGKPGEGKPEGGGEGKPGGKPGKPGEGGE GKPGGGKPEGEGKPGGGKPGGGEGGKPEGEGKPGGKPEGGGEGKPGGKPE GGGKPEGGGEGKPGGGKPGEGGKPGEGEGKPGGKPEGEGKPGGEGGGKPE GKPGGGEGGKPEGGKPGEGGKPEGGKPGEGGEGKPGGGKPGEGGKPEGGG KPEGEGKPGGGKPGEGGKPEGGKPEGGGEGKPGEGEGKPEGGGEGK PGGKPEGGGGKPGEGGKPEGGKPGGEGGGKPEGEGKPGGKPGEGGGKPG GKPEGEGKPGEGGEGKPGGKPEGGGEGKPGGKPEGGGEGKPGGGKPGEGG KPEGGGKPGEGGKPGEGGKPEGEGKPGGGEGKPGGKPGEGGKPEGGGEGK PGGKPGGEGGGKPEGGKPGEGGKPEG | 1134 | 18.5 |
| U576 | GEGKPGGKPGSGGGKPGEGGKPGSGEGKPGGKPGSGGSGKPGGKPGEGGK PEGGSGGKPGGGGKPGGKPGGEGSGKPGGKPEGGGKPEGGSGGKPGGKPE GGSGGKPGGKPGSGEGGKPGGGKPGGEGKPGSGKPGGEGSGKPGGKPEGG SGGKPGEGGSGGKPGGSGKPGGKPGEGGKPEGGSGGKPGGSGKPGGK PEGGGSGKPGGKPGEGGKPGSGEGGKPGGKPGGEGKPGSGKPGGEGSGK PGGKPGSGGEGKPGGKPEGGSGGKPGGKPGGEGKPGSGGKPGEGGKPGS GGGKPGGKPGGEGEGKPGGKPGEGGKPGGEGSGKPGGGGKPGGKPGGEG GKPEGSGKPGGGSGKPGGKPEGGGKPEGSGKPGGGGKPEGSGKPGGGKP EGGSGGKPGGSGKPGGKPGEGGGKPEGSGKPGGGSGKPGGKPEGGGKPEG GSGGKPGGKPEGGSGGKPGGKPGGEGSGKPGGKPGSGEGGKPGGKPGEGS GGKPGGKPEGGSGGKPGGSGKPGGKPEGGGSGKPGGKPGEGGKPGGEGSG KPGGSGKPG | 1135 | 18.1 |
| W576 | GGSGKPGKPGGSGSGKPGSGKPGGGSGKPGSGKPGGGSGKPGSGKPGGGSG KPGSGKPGGGGKPGSGSGKPGGGKPGSGGKPGGGSGKPGKPGSGGSGKP GSGKPGGSGGKPGKPGSGGSGGKPGKPGSGGGSGKPGKPGSGGSGGKPG KPGSGGSGGKPGKPGSGGSGKPGSGKPGGGSGKPGSGKPGSGGSGGKPGKPG SGGSGKPGSGKPGSGSGKPGSGKPGGGSGKPGSGKPGSGGSGKPGKPGSGG | 1136 | 23.4 |

TABLE 46-continued

Subsequence score calculations of polypeptide sequences

| Seq Name | Amino Acid Sequence | SEQ ID NO: | Score |
|---|---|---|---|
| | GKPGSGSGKPGGGKPGSGSGKPGGGKPGGSGGKPGGSGGKPGKPGSGGGS GKPGKPGSGGGSGKPGKPGGSGSGKPGSGKPGGGSGKPGSGKPGSGGSGKP GKPGSGGSGGKPGKPGSGGGKPGSGSGKPGGKPGSGSGKPGGGKPGSGSG KPGGGKPGSGSGKPGGSGKPGSGKPGGGSGGKPGKPGSGGGSGKPGSGKPGS GGSGKPGKPGGSGSGKPGSGKPGGGSGKPGSGKPGGGSGKPGSGKPGGGSG KPGSGKPGGGKPGSGSGKPGGSGGKPGKPGSGGSGGKPGKPGSGGSGKPG SGKPGGGSGGKPGKPGSGG | | |
| Y576 | GEGSGEGSEGEGSEGSGEGEGSEGSGEGEGGSEGSEGEGSEGSGEGEGGEGS GEGEGSGEGSEGEGGGEGSEGEGSGEGGEGEGSEGGSEGEGGSEGGEGEGS EGSGEGEGSEGGSEGEGSEGGSEGEGSEGSGEGEGSEGSGEGEGSEGSGEGE GSEGSGEGEGSEGGSEGEGSEGGSEGEGSEGEGEGSGEGEGSEGSGEGEGSGEG GEGSGEGSEGEGGSEGSEGEGGSEGSEGEGEGSGEGEGSEGSGEGEGSGEG SEGEGSEGSGEGEGSGEGSEGEGSGEGEGSGEGEGSEGSGEGEGSGEGEGSE GSGEGEGGSEGSEGEGGSEGSEGEGEGSEGSEGEGGEGSGEGEGSEGSGEGEG SEGSEGEGSEGSGEGEGSGEGEGGSEGSGEGEGSGEGEGSEGGSEGEGGSEGS EGEGSEGGSEGEGSEGSGEGSEGSGEGEGSGEGEGSGEGSEGEGSEGSGEGGSE GGEGEGSEGGSEGEGSEGGSEGEGGEGSGEGEGGGEGSEGEGSEGSGEGEG SGEGSE | 1137 | 15.7 |
| AD576 | GSSESGSSEGGPGSGGEPSESGSSGSSESGSSEGGPGSSESGSSEGGPGSSESG SSEGGPGSSESGSSEGGPGSSESGSSGSSESGSSGPGESS GSSESGSSEGGPGSSESGSSEGGPGSSESGSSEGGPGSGGEPSESGSSGESPGG SSGSESGESPGGSSGSESGSSGGGEPSESGSSGSSESGSSEGGPGSGGEPSESGSS GSSGGEPSESGSSGSEGSSGPGESSGESPGGSSGSESGSGGEPSESGSSGSGGEP SESGSSGSGGEPSESGSSGSSESGSSEGGPGESPGGSSGSESGESPGGSSGSES GESPGGSSGSESGESPGGSSGSESGSGESPGGSSGSESGSSEGGPGSGGEP SESGSSGSESGSGPGESSGSSEGGPGSGGEPSESGSSGSSESGSSEGGP GSGGEPSESGSSGESPGGSSGSESGESPGGSSGSESGSSESGSSEGGPGSGGEP SESGSSGSSESGSSEGGPGSGGEPSESGSSGSGGEPSESGSSGESPGGSSGSES GSEGSSGPGESSGSSESGSSEGGPGSEGSSGPGESS | 1138 | 13.6 |
| AE576 | AGSPAGSPTSTEEGTSESATPESGPGTSTEPSEGSAPGSPAGSPTSTEEGTSTEP SEGSAPGTSTEPSEGSAPGTSESATPESGPGSEPATSGSETPGSEPATSGSETPG SPAGSPTSTEEGTSESATPESGPGTSTEPSEGSAPGTSTEPSEGSAPGSPAGSPT STEEGTSTEPSEGSAPGTSTEPSEGSAPGTSESATPESGPGTSTEPSEGSAPGTS ESATPESGPGSEPATSGSETPGTSTEPSEGSAPGTSTEPSEGSAPGTSESATPES GPGTSESATPESGPGSPAGSPTSTEEGTSESATPESGPGSEPATSGSETPGTSES ATPESGPGTSTEPSEGSAPGTSTEPSEGSAPGTSTEPSEGSAP GTSTEPSEGSAPGTSTEPSEGSAPGSPAGSPTSTEEGTSTEPSEGSAPGTSESAT PESGPGSEPATSGSETPGTSESATPESGPGSEPATSGSETPGTSESATPESGPGT STEPSEGSAPGTSESATPESGPGSPAGSPTSTEEGSPAGSPTSTEEGSPAGSPTS TEEGTSESATPESGPGTSTEPSEGSAP | 1139 | 6.1 |
| AF540 | GSTSSTAESPGPGSTSSTAESPGPGSTSESPSGTAPGSTSSTAESPGPGSTSSTA ESPGPGTSTPESGSASPGSTSESPSGTAPGTSPSGESSTAPGSTSESPSGTAPGS TSESPSGTAPGTSPSGESSTAPGSTSESPSGTAPGSTSESPSGTAPGTSPSGESS TAPGSTSESPSGTAPGSTSESPSGTAPGSTSESPSGTAPGTSTPESGSASPGSTS ESPSGTAPGSTSTPESGSASPGSTSSTAESPGPGSTSSTAESPGPGSTSTPESGSAS PGTSTPESGSASPGSTSESPSGTAPGTSTPESGSASPGTSTPESGSASPGSTSES PSGTAPGSTSESPSGTAPGSTSESPSGTAPGSTSSTAESPGPGSTSTPESGSASPG TSTPESGSASPGSTSESPSGTAPGSTSESPSGTAPGTSTPESGSASPGSTSESPS GTAPGSTSESPSGTAPGSTSTPESGSASPGTSPSGESSTAPGSTSSTAESPGPGTS PSGESSTAPGSTSSTAESPGPGSTSTPESGSASPGSTSESPSGTAP | 1140 | 8.8 |
| AF504 | GASPGTSSTGSPGSSPSASTGTGPGSSPSASTGTGPGTPGSGTASSSPGSSTPS GATGSPGSNPSASTGTGPGASPGTSSTGSPGPTPGSGTASSSPGSSTPSGATGSP GTPGSGTASSSPGASPGTSSTGSPGASPGTSSTGSPGPTPGSGTASSSPGSSTPS GATGSPGASPGTSSTGSPGPTPGSGTASSSPGSSTPSGATGSPGSNPSASTGTGP GSSPSASTGTGPGSSTPSGATGSPGSSTPSGATGSPGASPGTSSTGSPGASPGT SSTGSPGASPGTSSTGSPGPTPGSGTASSSPGASPGTSSTGSPGASPGTSSTGSP GASPGTSSTGSPGSSPSASTGTGPGTPGSGTASSSPGASPGTSSTGSPGASPGT SSTGSPGASPGTSSTGSPGSSTPSGATGSPGSSTPSGATGSPGASPGTSSTGSP GTPGSGTASSSPGSSTPSGATGSPGSSTPSGATGSPGSSTPSGATGSPGSSPSAS TGTGPGASPGTSSTGSP | 1141 | 7.0 |
| AE864 | GSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGS PAGSPTSTEEGTSESATPESGPGTSTEPSEGSAPGTSTEPSEGSAPGSPAGSPTS TEEGTSTEPSEGSAPGTSTEPSEGSAPGTSESATPESGPGTSTEPSEGSAPGTSE SATPESGPGSEPATSGSETPGTSTEPSEGSAPGTSTEPSEGSAPGTSESATPESG PGTSESATPESGPGSPAGSPTSTEEGTSESATPESGPGSEPATSGSETPGTSESA TPESGPGTSTEPSEGSAPGTSTEPSEGSAPGTSTEPSEGSAPGTSTEPSEGSAPG TSTEPSEGSAPGTSTEPSEGSAPGSPAGSPTSTEEGTSTEPSEGSAPGTSESATP | 1142 | 6.1 |

TABLE 46-continued

Subsequence score calculations of polypeptide sequences

| Seq Name | Amino Acid Sequence | SEQ ID NO: | Score |
|---|---|---|---|
| | ESGPGSEPATSGSETPGTSESATPESGPGSEPATSGSETPGTSESATPESGPGTS TEPSEGSAPGTSESATPESGPGSPAGSPTSTEEGSPAGSPTSTEEGSPAGSPTST EEGTSESATPESGPGTSTEPSEGSAPGTSESATPESGPGSEPATSGSETPGTSES ATPESGPGSEPATSGSETPGTSESATPESGPGTSTEPSEGSAPGSPAGSPTSTEE GTSESATPESGPGSEPATSGSETPGTSESATPESGPGSPAGSPTSTEEGSPAGSP TSTEEGTSTEPSEGSAPGTSESATPESGPGTSESATPESGPGTSESATPESGPGS EPATSGSETPGSEPATSGSETPGSPAGSPTSTEEGTSTEPSEGSAP | | |
| AF864 | GSTSESPSGTAPGTSPSGESSTAPGSTSESPSGTAPGSTSESPSGTAPGTSTPES GSASPGTSTPESGSASPGTSESPSGTAPGSTSESPSGTAPGTSPSGESSTAPGS TSESPSGTAPGTSPSGESSTAPGTSPSGESSTAPGSTSSTAESPGPGTSPSGESS TAPGTSPSGESSTAPGSTSSTAESPGPGTSTPESGSASPGTSTPESGSASPGSTS ESPSGTAPGSTSESPSGTAPGTSTPESGSASPGSTSSTAESPGPGTSTPESGSAS PGSTSESPSGTAPGTSPSGESSTAPGSTSSTAESPGPGTSPSGESSTAPGTSTPE SGSASPGSTSSTAESPGPGSTSSTAESPGPGSTSSTAESPGPGSTSSTAESPGPG TSPSGESSTAPGSTSESPSGTAPGSTSESPSGTAPGTSTPESGPXXXGASASGA PSTXXXXSESPSGTAPGSTSESPSGTAPGSTSESPSGTAPGSTSESPSGTAPGST SESPSGTAPGSTSESPSGTAPGTSTPESGSASPGTSPSGESSTAPGTSPSGESST APGSTSSTAESPGPGTSPSGESSTAPGTSTPESGSASPGTSESPSGTAPGSTSE SPSGTAPGTSPSGESSTAPGSTSESPSGTAPGTSTPESGSASPGTSTPESGSASP GSTSESPSGTAPGTSTPESGSASPGSTSSTAESPGPGTSESPSGTAPGSTSESP SGTAPGTSPSGESSTAPGSTSSTAESPGPGTSPSGESSTAPGTSTPESGSASPGT SPSGESSTAPGTSPSGESSTAPGTSPSGESSTAPGSTSSTAESPGPGTSSTAES PGPGTSPSGESSTAPGSSPSASTGTGPGSSTPSGATGSPGSSTPSGATGSP | 1143 | 7.5 |
| AG868 | GGSPGASPGTSSTGSPGSSPSASTGTGPGSSPSASTGTGPGTPGSGTASSSPGS STPSGATGSPGSNPSASTGTGPGASPGTSSTGSPGTPGSGTASSSPGSSTPSGA TGSPGTPGSGTASSSPGASPGTSSTGSPGASPGTSSTGSPGTPGSGTASSSPGS STPSGATGSPGASPGTSSTGSPGTPGSGTASSSPGSSTPSGATGSPGSNPSAST GTGPGSSPSASTGTGPGSSTPSGATGSPGSSTPSGATGSPGASPGTSSTGSPGA SPGTSSTGSPGASPGTSSTGSPGTPGSGTASSSPGASPGTSSTGSPGASPGTSST GSPGASPGTSSTGSPGSSPSASTGTGPGTPGSGTASSSPGASPGTSSTGSPGAS PGTSSTGSPGASPGTSSTGSPGSSTPSGATGSPGSSTPSGATGSPGASPGTSST GSPGTPGSGTASSSPGSSTPSGATGSPGSSTPSGATGSPGSSTPSGATGSPGSSP SASTGTGPGASPGTSSTGSPGASPGTSSTGSPGTPGSGTASSSPGASPGTSSTG SPGASPGTSSTGSPGASPGTSSTGSPGASPGTSSTGSPGTPGSGTASSSPGSSTP SGATGSPGTPGSGTASSSPGSSTPSGATGSPGTPGSGTASSSPGSSTPSGATGS PGSSTPSGATGSPGSSPSASTGTGPGSSPSASTGTGPGASPGTSSTGSPGTPGS GTASSSPGSSTPSGATGSPGSSPSASTGTGPGSSPSASTGTGPGASPGTSSTGS PGASPGTSSTGSPGSSTPSGATGSPGSSPSASTGTGPGASPGTSSTGSPGSSPSA STGTGPGTPGSGTASSSPGSSTPSGATGSPGSSTPSGATGSPGASPGTSSTGSP | 1144 | 7.5 |
| AM875 | GTSTEPSEGSAPGSEPATSGSETPGSPAGSPTSTEEGSTSSTAESPGPGTSTPES GSASPGSTSESPSGTAPGSTSESPSGTAPGTSTPESGSASPGTSTPESGSASPGS EPATSGSETPGTSESATPESGPGSPAGSPTSTEEGTSTEPSEGSAPGTSESATPE SGPGTSTEPSEGSAPGTSTEPSEGSAPGSPAGSPTSTEEGTSTEPSEGSAPGTST EPSEGSAPGTSESATPESGPGTSESATPESGPGTSTEPSEGSAPGTSTEPSEGSA PGTSESATPESGPGTSTEPSEGSAPGSEPATSGSETPGSPAGSPTSTEEGSSTPS GATGSPGTPGSGTASSSPGSSTPSGATGSPGTSTEPSEGSAPGTSTEPSEGSAP GSEPATSGSETPGSPAGSPTSTEEGSPAGSPTSTEEGTSTEPSEGSAPGASASG APSTGGTSESATPESGPGSPAGSPTSTEEGSPAGSPTSTEEGTSSTAESPGPGS TSESPSGTAPGTSPSGESSTAPGTPGSGTASSSPGSSTPSGATGSPGSSPSASTG TGPGSEPATSGSETPGTSESATPESGPGSEPATSGSETPGSTSSTAESPGPGSTS STAESPGPGTSPSGESSTAPGSEPATSGSETPGSEPATSGSETPGTSTEPSEGSA PGSTSSTAESPGPGTSTPESGSASPGSTSESPSGTAPGTSTEPSEGSAPGTSTEP SEGSAPGTSTEPSEGSAPGSSTPSGATGSPGSSPSASTGTGPGASPGTSSTGSP GSEPATSGSETPGTSESATPESGPGSPAGSPTSTEEGSSTPSGATGSPGSSPSAS TGTGPGASPGTSSTGSPGTSESATPESGPGTSTEPSEGSAPGTSTEPSEGSAP | 1145 | 4.5 |
| AM1318 | GTSTEPSEGSAPGSEPATSGSETPGSPAGSPTSTEEGSTSSTAESPGPGTSTPES GSASPGSTSESPSGTAPGSTSESPSGTAPGTSTPESGSASPGTSTPESGSASPGS EPATSGSETPGTSESATPESGPGSPAGSPTSTEEGTSTEPSEGSAPGTSESATPE SGPGTSTEPSEGSAPGTSTEPSEGSAPGSPAGSPTSTEEGTSTEPSEGSAPGTST EPSEGSAPGTSESATPESGPGTSESATPESGPGTSTEPSEGSAPGTSTEPSEGSA PGTSESATPESGPGTSTEPSEGSAPGSEPATSGSETPGSPAGSPTSTEEGSSTPS GATGSPGTPGSGTASSSPGSSTPSGATGSPGTSTEPSEGSAPGTSTEPSEGSAP GSEPATSGSETPGSPAGSPTSTEEGSPAGSPTSTEEGTSTEPSEGSAPGPEPTGP APSGGSEPATSGSETPGTSESATPESGPGSPAGSPTSTEEGTSESATPESGPGSP AGSPTSTEEGSPAGSPTSTEEGTSESATPESGPGSPAGSPTSTEEGSPAGSPTST EEGTSSTAESPGPGSTSESPSGTAPGTSPSGESSTAPGSTSESPSGTAPGSTSE SPSGTAPGTSPSGESSTAPGTSTEPSEGSAPGTSESATPESGPGTSESATPESGP GSEPATSGSETPGTSESATPESGPGSEPATSGSETPGTSTEPSEGSAPGTSESAT PESGPGTSTEPSEGSAPGTSPSGESSTAPGTSPSGESSTAPGTSPSGESSTAPGT STEPSEGSAPGSPAGSPTSTEEGTSTEPSEGSAPGSSPSASTGTGPGSSTPSGAT GSPGSSTPSGATGSPGSSTPSGATGSPGSSTPSGATGSPGASPGTSSTGSPGAS | 1146 | 4.5 |

TABLE 46-continued

Subsequence score calculations of polypeptide sequences

| Seq Name | Amino Acid Sequence | SEQ ID NO: | Score |
|---|---|---|---|
| | ASGAPSTGGTSPSGESSTAPGSTSSTAESPGPGTSPSGESSTAPGTSESATPESG PGTSTEPSEGSAPGTSTEPSEGSAPGSSPSASTGTGPGSSTPSGATGSPGASPG TSSTGSPGTSTPESGSASPGTSPSGESSTAPGTSPSGESSTAPGTSESATPESGP GSEPATSGSETPGTSTEPSEGSAPGSTSESPSGTAPGSTSESPSGTAPGTSTPES GSASPGSPAGSPTSTEEGTSESATPESGPGTSTEPSEGSAPGSPAGSPTSTEEGT SESATPESGPGSEPATSGSETPGSSTPSGATGSPGASPGTSSTGSPGSSTPSGAT GSPGSTSESPSGTAPGTSPSGESSTAPGSTSSTAESPGPGSSTPSGATGSPGASP GTSSTGSPGTPGSGTASSSPGSPAGSPTSTEEGSPAGSPTSTEEGTSTEPSEGSA P | | |

Example 61: Calculation of TEPITOPE Scores

TEPITOPE scores of 9mer peptide sequence can be calculated by adding pocket potentials as described by Sturniolo [Sturniolo, T., et al. (1999) Nat Biotechnol, 17: 555]. In the present Example, separate Tepitope scores were calculated for individual HLA alleles. Table 47 shows as an example the pocket potentials for HLA*0101B, which occurs in high frequency in the Caucasian population. To calculate the TEPITOPE score of a peptide with sequence P1-P2-P3-P4-P5-P6-P7-P8-P9, the corresponding individual pocket potentials in Table 47 were added. The HLA*0101B score of a 9mer peptide with the sequence FDKLPRTSG (SEQ ID NO: 1147) is the sum of 0, −1.3, 0, 0.9, 0, −1.8, 0.09, 0, 0.

To evaluate the TEPITOPE scores for long peptides one can repeat the process for all 9mer subsequences of the sequences. This process can be repeated for the proteins encoded by other HLA alleles. Tables 48-51 give pocket potentials for the protein products of HLA alleles that occur with high frequency in the Caucasian population.

TEPITOPE scores calculated by this method range from approximately −10 to +10. However, 9mer peptides that lack a hydrophobic amino acid (FKLMVWY) (SEQ ID NO: 1148) in P1 position have calculated TEPITOPE scores in the range of −1009 to −989. This value is biologically meaningless and reflects the fact that a hydrophobic amino acid serves as an anchor residue for HLA binding and peptides lacking a hydrophobic residue in P1 are considered non binders to HLA. Because most XTEN sequences lack hydrophobic residues, all combinations of 9mer subsequences will have TEPITOPEs in the range in the range of −1009 to −989. This method confirms that XTEN polypeptides may have few or no predicted T-cell epitopes.

TABLE 47

Pocket potential for HLA*0101B allele.

| Amino Acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −2.4 | — | −2.7 | −2 | — | −1.9 |
| E | −999 | 0.1 | −1.2 | −0.4 | — | −2.4 | −0.6 | — | −1.9 |
| F | 0 | 0.8 | 0.8 | 0.08 | — | −2.1 | 0.3 | — | −0.4 |
| G | −999 | 0.5 | 0.2 | −0.7 | — | −0.3 | −1.1 | — | −0.8 |
| H | −999 | 0.8 | 0.2 | −0.7 | — | −2.2 | 0.1 | — | −1.1 |
| I | −1 | 1.1 | 1.5 | 0.5 | — | −1.9 | 0.6 | — | 0.7 |
| K | −999 | 1.1 | 0 | −2.1 | — | −2 | −0.2 | — | −1.7 |
| L | −1 | 1 | 1 | 0.9 | — | −2 | 0.3 | — | 0.5 |
| M | −1 | 1.1 | 1.4 | 0.8 | — | −1.8 | 0.09 | — | 0.08 |
| N | −999 | 0.8 | 0.5 | 0.04 | — | −1.1 | 0.1 | — | −1.2 |

TABLE 47-continued

Pocket potential for HLA*0101B allele.

| Amino Acid | P1 | P2 | P3 | P4 | P5 | P6 | P7 | P8 | P9 |
|---|---|---|---|---|---|---|---|---|---|
| P | −999 | −0.5 | 0.3 | −1.9 | — | −0.2 | 0.07 | — | −1.1 |
| Q | −999 | 1.2 | 0 | 0.1 | — | −1.8 | 0.2 | — | −1.6 |
| R | −999 | 2.2 | 0.7 | −2.1 | — | −1.8 | 0.09 | — | −1 |
| S | −999 | −0.3 | 0.2 | −0.7 | — | −0.6 | −0.2 | — | −0.3 |
| T | −999 | 0 | 0 | −1 | — | −1.2 | 0.09 | — | −0.2 |
| V | −1 | 2.1 | 0.5 | −0.1 | — | −1.1 | 0.7 | — | 0.3 |
| W | 0 | −0.1 | 0 | −1.8 | — | −2.4 | −0.1 | — | −1.4 |
| Y | 0 | 0.9 | 0.8 | −1.1 | — | −2 | 0.5 | — | −0.9 |

TABLE 48

Pocket potential for HLA*0301B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | 2.3 | — | −2.4 | −0.6 | — | −0.6 |
| E | −999 | 0.1 | −1.2 | −1 | — | −1.4 | −0.2 | — | −0.3 |
| F | −1 | 0.8 | 0.8 | −1 | — | −1.4 | 0.5 | — | 0.9 |
| G | −999 | 0.5 | 0.2 | 0.5 | — | −0.7 | 0.1 | — | 0.4 |
| H | −999 | 0.8 | 0.2 | 0 | — | −0.1 | −0.8 | — | −0.5 |
| I | 0 | 1.1 | 1.5 | 0.5 | — | 0.7 | 0.4 | — | 0.6 |
| K | −999 | 1.1 | 0 | −1 | — | 1.3 | −0.9 | — | −0.2 |
| L | 0 | 1 | 1 | 0 | — | 0.2 | 0.2 | — | −0 |
| M | 0 | 1.1 | 1.4 | 0 | — | −0.9 | 1.1 | — | 1.1 |
| N | −999 | 0.8 | 0.5 | 0.2 | — | −0.6 | −0.1 | — | −0.6 |
| P | −999 | −0.5 | 0.3 | −1 | — | 0.5 | 0.7 | — | −0.3 |
| Q | −999 | 1.2 | 0 | 0 | — | −0.3 | −0.1 | — | −0.2 |
| R | −999 | 2.2 | 0.7 | −1 | — | 1 | −0.9 | — | 0.5 |
| S | −999 | −0.3 | 0.2 | 0.7 | — | −0.1 | 0.07 | — | 1.1 |
| T | −999 | 0 | 0 | −1 | — | 0.8 | −0.1 | — | −0.5 |
| V | 0 | 2.1 | 0.5 | 0 | — | 1.2 | 0.2 | — | 0.3 |
| W | −1 | −0.1 | 0 | −1 | — | −1.4 | −0.6 | — | −1 |
| Y | −1 | 0.9 | 0.8 | −1 | — | −1.4 | −0.1 | — | 0.3 |

TABLE 49

Pocket potential for HLA*0401B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | 1.4 | — | −1.1 | −0.3 | — | −1.7 |
| E | −999 | 0.1 | −1.2 | 1.5 | — | −2.4 | 0.2 | — | −1.7 |
| F | 0 | 0.8 | 0.8 | −0.9 | — | −1.1 | −1 | — | −1 |
| G | −999 | 0.5 | 0.2 | −1.6 | — | −1.5 | −1.3 | — | −1 |
| H | −999 | 0.8 | 0.2 | 1.1 | — | −1.4 | 0 | — | 0.08 |

TABLE 49-continued

Pocket potential for HLA*0401B allele.

| Amino acid | P1 | P2 | P3 | P4 | P5 | P6 | P7 | P8 | P9 |
|---|---|---|---|---|---|---|---|---|---|
| I | −1 | 1.1 | 1.5 | 0.8 | — | −0.1 | 0.08 | — | −0.3 |
| K | −999 | 1.1 | 0 | −1.7 | — | −2.4 | −0.3 | — | −0.3 |
| L | −1 | 1 | 1 | 0.8 | — | −1.1 | 0.7 | — | −1 |
| M | −1 | 1.1 | 1.4 | 0.9 | — | −1.1 | 0.8 | — | −0.4 |
| N | −999 | 0.8 | 0.5 | 0.9 | — | 1.3 | 0.6 | — | −1.4 |
| P | −999 | −0.5 | 0.3 | −1.6 | — | 0 | −0.7 | — | −1.3 |
| Q | −999 | 1.2 | 0 | 0.8 | — | −1.5 | 0 | — | 0.5 |
| R | −999 | 2.2 | 0.7 | −1.9 | — | −2.4 | −1.2 | — | −1 |
| S | −999 | −0.3 | 0.2 | 0.8 | — | 1 | −0.2 | — | 0.7 |
| T | −999 | 0 | 0 | 0.7 | — | 1.9 | −0.1 | — | −1.2 |
| V | −1 | 2.1 | 0.5 | −0.9 | — | 0.9 | 0.08 | — | −0.7 |
| W | 0 | −0.1 | 0 | −1.2 | — | −1 | −1.4 | — | −1 |
| Y | 0 | 0.9 | 0.8 | −1.6 | — | −1.5 | −1.2 | — | −1 |

TABLE 50

Pocket potential for HLA*0701B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −1.6 | — | −2.5 | −1.3 | — | 1.2 |
| E | −999 | 0.1 | −1.2 | −1.4 | — | −2.5 | 0.9 | — | −0.3 |
| F | 0 | 0.8 | 0.8 | 0.2 | — | −0.8 | 2.1 | — | 2.1 |
| G | −999 | 0.5 | 0.2 | −1.1 | — | −0.6 | 0 | — | −0.6 |
| H | −999 | 0.8 | 0.2 | 0.1 | — | −0.8 | 0.9 | — | −0.2 |
| I | −1 | 1.1 | 1.5 | 1.1 | — | −0.5 | 2.4 | — | 3.4 |
| K | −999 | 1.1 | 0 | −1.3 | — | −1.1 | 0.5 | — | −1.1 |
| L | −1 | 1 | 1 | −0.8 | — | −0.9 | 2.2 | — | 3.4 |
| M | −1 | 1.1 | 1.4 | −0.4 | — | −0.8 | 1.8 | — | 2 |
| N | −999 | 0.8 | 0.5 | −1.1 | — | −0.6 | 1.4 | — | −0.5 |
| P | −999 | −0.5 | 0.3 | −1.2 | — | −0.5 | −0.2 | — | −0.6 |
| Q | −999 | 1.2 | 0 | −1.5 | — | −1.1 | 1.1 | — | −0.9 |
| R | −999 | 2.2 | 0.7 | −1.1 | — | −1.1 | 0.7 | — | −0.8 |
| S | −999 | −0.3 | 0.2 | 1.5 | — | 0.6 | 0.4 | — | −0.3 |
| T | −999 | 0 | 0 | 1.4 | — | −0.1 | 0.9 | — | 0.4 |
| V | −1 | 2.1 | 0.5 | 0.9 | — | 0.1 | 1.6 | — | 2 |
| W | 0 | −0.1 | 0 | −1.1 | — | −0.9 | 1.4 | — | 0.8 |
| Y | 0 | 0.9 | 0.8 | −0.9 | — | −1 | 1.7 | — | 1.1 |

TABLE 51

Pocket potential for HLA*1501B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −0.4 | — | −0.4 | −0.7 | — | −1.9 |
| E | −999 | 0.1 | −1.2 | −0.6 | — | −1 | −0.7 | — | −1.9 |
| F | −1 | 0.8 | 0.8 | 2.4 | — | −0.3 | 1.4 | — | −0.4 |
| G | −999 | 0.5 | 0.2 | 0 | — | 0.5 | 0 | — | −0.8 |
| H | −999 | 0.8 | 0.2 | 1.1 | — | −0.5 | 0.6 | — | −1.1 |
| I | 0 | 1.1 | 1.5 | 0.6 | — | 0.05 | 1.5 | — | 0.7 |
| K | −999 | 1.1 | 0 | −0.7 | — | −0.3 | −0.3 | — | −1.7 |
| L | 0 | 1 | 1 | 0.5 | — | 0.2 | 1.9 | — | 0.5 |
| M | 0 | 1.1 | 1.4 | 1 | — | 0.1 | 1.7 | — | 0.08 |
| N | −999 | 0.8 | 0.5 | −0.2 | — | 0.7 | 0.7 | — | −1.2 |
| P | −999 | −0.5 | 0.3 | −0.3 | — | −0.2 | 0.3 | — | −1.1 |
| Q | −999 | 1.2 | 0 | −0.8 | — | −0.8 | −0.3 | — | −1.6 |
| R | −999 | 2.2 | 0.7 | 0.2 | — | 1 | −0.5 | — | −1 |
| S | −999 | −0.3 | 0.2 | −0.3 | — | 0.6 | 0.3 | — | −0.3 |
| T | −999 | 0 | 0 | −0.3 | — | −0 | 0.2 | — | −0.2 |
| V | 0 | 2.1 | 0.5 | 0.2 | — | −0.3 | 0.3 | — | 0.3 |
| W | −1 | −0.1 | 0 | 0.4 | — | −0.4 | 0.6 | — | −1.4 |
| Y | −1 | 0.9 | 0.8 | 2.5 | — | 0.4 | 0.7 | — | −0.9 |

Example 62: GPCR Ca2+ Mobilization Activity Assay

Figure 110:
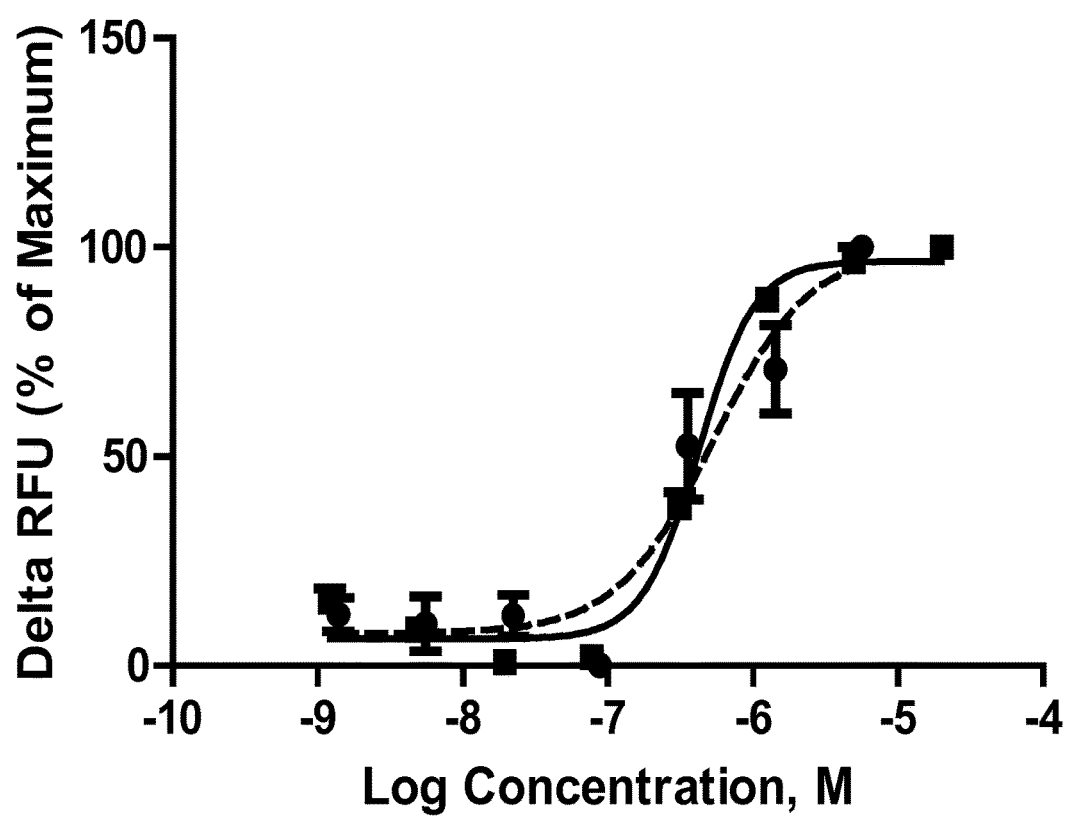
FIG. 110 shows the results of GPCR $Ca^{2+}$ mobilization activity of recombinant GLP2-2G-XTEN (filled squares) and conjugate GLP2-2G-XTEN (filled circles), performed as described in Example 62.

Recombinant GLP2-2G-XTEN was prepared as described in Alters, S. et al. (2012) GLP2-2G-XTEN: a pharmaceutical protein with improved serum half-life and efficacy in a rat Crohn's disease model. PLoS One; 7(11): e50630. The conjugate GLP2-2G-XTEN was prepared as described in Example 26 (FIG. 68) and purified by preparative RP-HPLC (FIG. 70). A GPCR Ca2+ flux mobilization activity assay was performed using an EMD Millipore ChemiSCREEN human recombinant GLP-2 glucagon family receptor calcium-optimized stable cell line, used according to manufacturer's instructions, with results presented in FIG. 110. Both the recombinant and conjugated GLP2-2G-XTEN were profiled as an eight-point, three-fold serial dilution dose response curve. Dose response curves were fitted using a 4PL-regression plot with respective Y-axis RFU, with data expressed as a percentage of absolute maximum RFU against concentration on the X-axis. Both recombinant GLP2-2G-XTEN and conjugate GLP2-2G-XTEN exhibited dose-dependent agonist activity with predicted EC50 potency values of 423 nM and 529 nM, respectively.

Example 63: In Vitro Plasma Stability Assay of Conjugate GLP2-2G-XTEN

Figure 111:
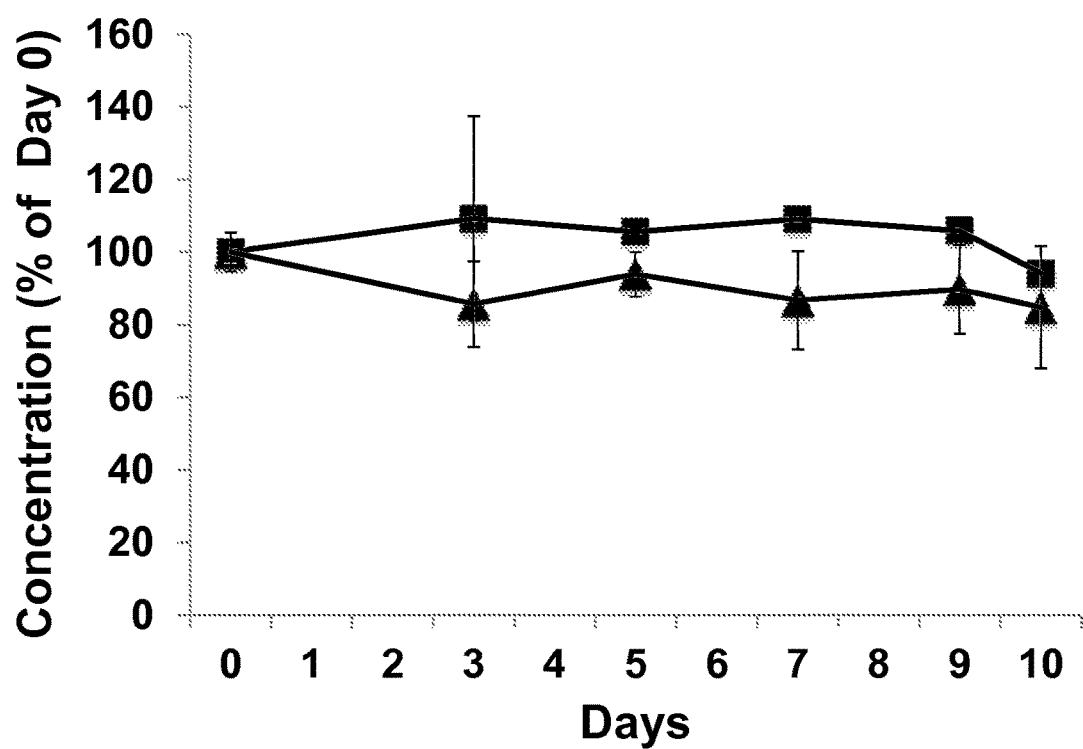
FIG. 111 shows the results of an in vitro human plasma stability of recombinant GLP2-2G-XTEN (filled squares) and conjugate GLP2-2G-XTEN (filled triangles) at various time points at 37° C., performed as described in Example 63.

Equal concentrations of recombinant GLP2-2G-XTEN and conjugate GLP2-2G-XTEN were independently spiked into respective rat, cynomolgus monkey and human plasma. Samples were incubated at 37° C. for up to 10 days with an aliquot removed at appropriate time interval and stored at −80° C. until analysis. The plasma stability of conjugated GLP2-2G-XTEN in the various species was compared to that of recombinant GLP2-2G-XTEN on an anti-XTEN/GLP2 ELISA performed in the respective plasma matrices. The anti-XTEN/GLP2 ELISA comprised of the anti-XTEN mouse antibody as a capture antibody and a biotinylated anti-human GLP2 antibody as a detection antibody. As shown in FIG. 111, the in vitro stability in human plasma of conjugate GLP2-2G-XTEN is comparable to that of recombinant GLP2-2G-XTEN having an calculated stability half-life of >240 h. Similar in vitro stability was also observed with the two GLP2-2G-XTEN proteins in rat and cynomolgus monkey plasma (data not shown).

Example 64: Pharmacokinetics of Conjugate GLP2-2G-XTEN in Rats

Figure 112:
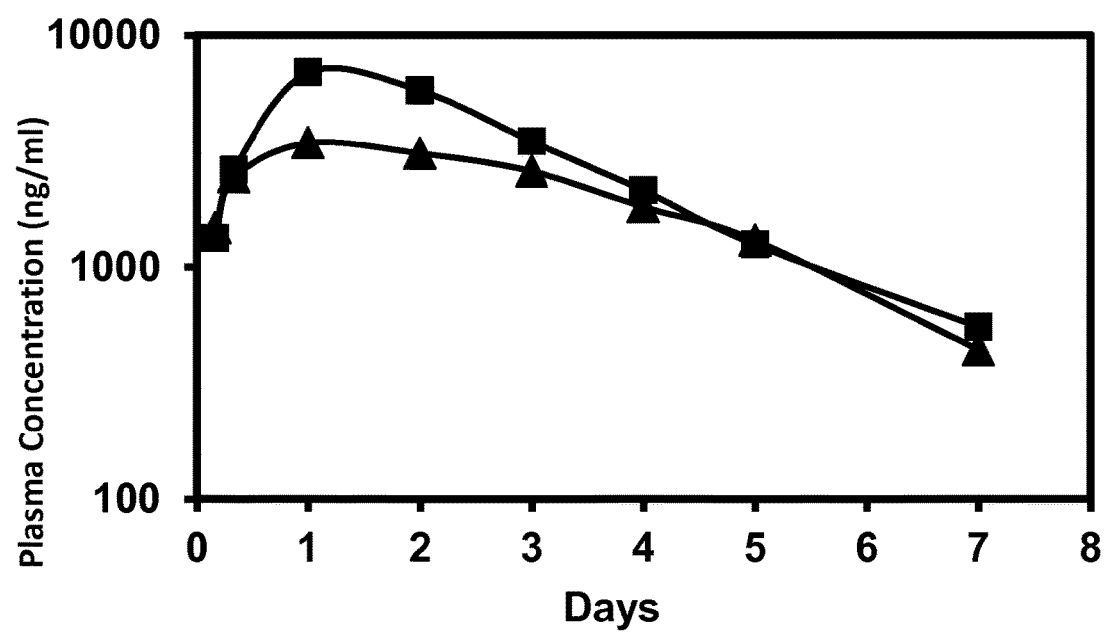
FIG. 112 shows the results of the pharmacokinetic profile of recombinant GLP2-2G-XTEN (filled squares) and conjugate GLP2-2G-XTEN (filled triangles) in rats, performed as described in Example 64.

Female SD strain rats (200-220 g) were randomly assigned into groups of 3 animals each. Recombinant GLP-2G-XTEN and conjugate GLP2-2G-XTEN were administered by subcutaneous injection at 2 mg/kg into each animal. Blood samples (0.2 ml) were collected in pre-chilled heparinized microtainer tubes at pre-dose, 0.08, 4, 8, 24, 48, 72, 96, 120 and 168 hours after test compound administration. The blood was then processed to plasma and stored immediately at −80° C. until analysis. Plasma samples were analyzed using an anti-XTEN/GLP2 ELISA that uses the mouse anti-XTEN antibody as a capture antibody and a biotinylated anti-human GLP2 antibody as a detection antibody. The ELISA was performed using relevant recombinant GLP2-2G-XTEN or conjugate GLP2-2G-XTEN as the respective ELISA calibration standards (FIG. 112). The calculated half-life of recombinant GLP2-2G-XTEN (36 (±7) h) and conjugate GLP2-2G-XTEN (37 (±7) h) was found to be similar.

Example 65: Trimeric XTEN Conjugate Linked Via C-Terminal Cysteines

Figure 113:
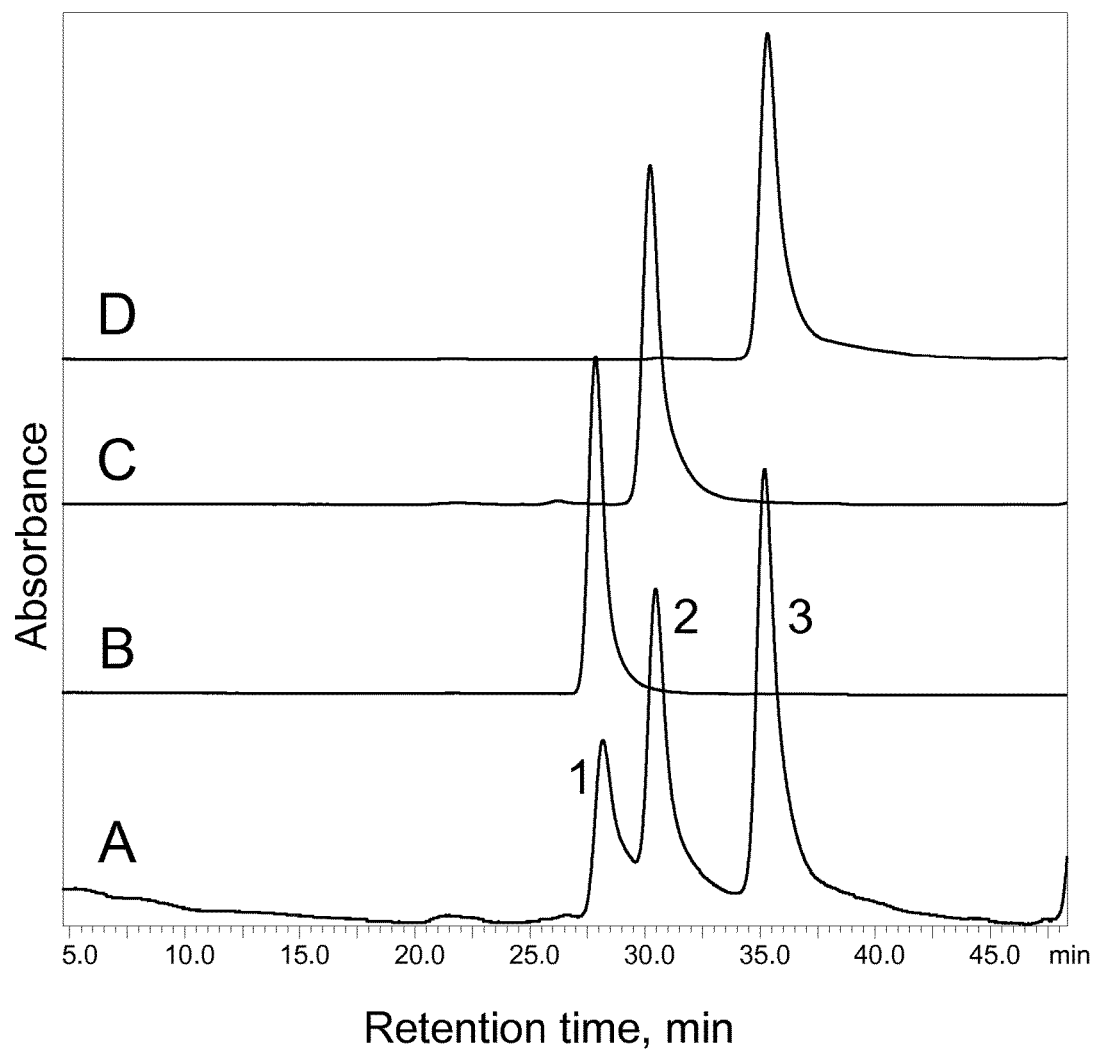
FIG. 113.

A trimeric XTEN conjugate was prepared by the following procedure. An aliquot of the XTEN protein 1×Amino, 1×Thiol-XTEN432 (XTEN_AE432(Am1,C422)), with one internal cysteine residue, was prepared as a 587 µM (23.23 mg/ml) solution in 20 mM HEPES, pH 7.0, 50 mM NaCl. Tris-[2-maleimidoethyl]amine (TMEA, Thermo Scientific, cat. #33043) was dissolved in anhydrous DMF to a final concentration 10 mM. TMEA was added to the protein solution to link to the thiol group of the XTEN (5× molar excess of protein over linker). The reaction mixture was incubated for 2 hrs at 25° C. and the products of the reaction were analyzed by SEC-HPLC (Phenomenex BioSep-SEC-s4000 600×7.80 mm, buffer: 50 mM Sodium Phosphate pH 6.5, 300 mM NaCl, flow rate 0.5 ml/min, isocratic elution for 70 min). Linear XTEN_432, XTEN_864 and XTEN_1296 (having 432, 864, and 1296 amino acids, respectively) were analyzed under the same conditions to identify reaction products (FIG. 113). Peak 1 eluted at 28 min, the same time as XTEN_1296 and was identified as a trimer of XTEN_432. Peak 2 eluted at 30.5 min, the same time as XTEN_864 and was identified as a dimer of XTEN_432. Peak 3 eluted at 35 min, the same time as XTEN_432 and was identified as XTEN_432 precursor. The yields of trimeric XTEN conjugate and dimeric XTEN conjugate were 19% and 36%, respectively. Essentially identical retention times for the trimeric conjugate 3×XTEN_432 and the linear molecule XTEN_1296 suggest that the apparent molecular weight and hydrodynamic radius of an XTEN protein is not dependent on its geometric configuration.

Example 66: Trimeric XTEN Conjugates Linked Via N-Terminal α-Amino Groups

A trimeric XTEN conjugate was prepared by the following procedure.

1. Synthesis of 1×DBCO-XTEN288

Figure 114:
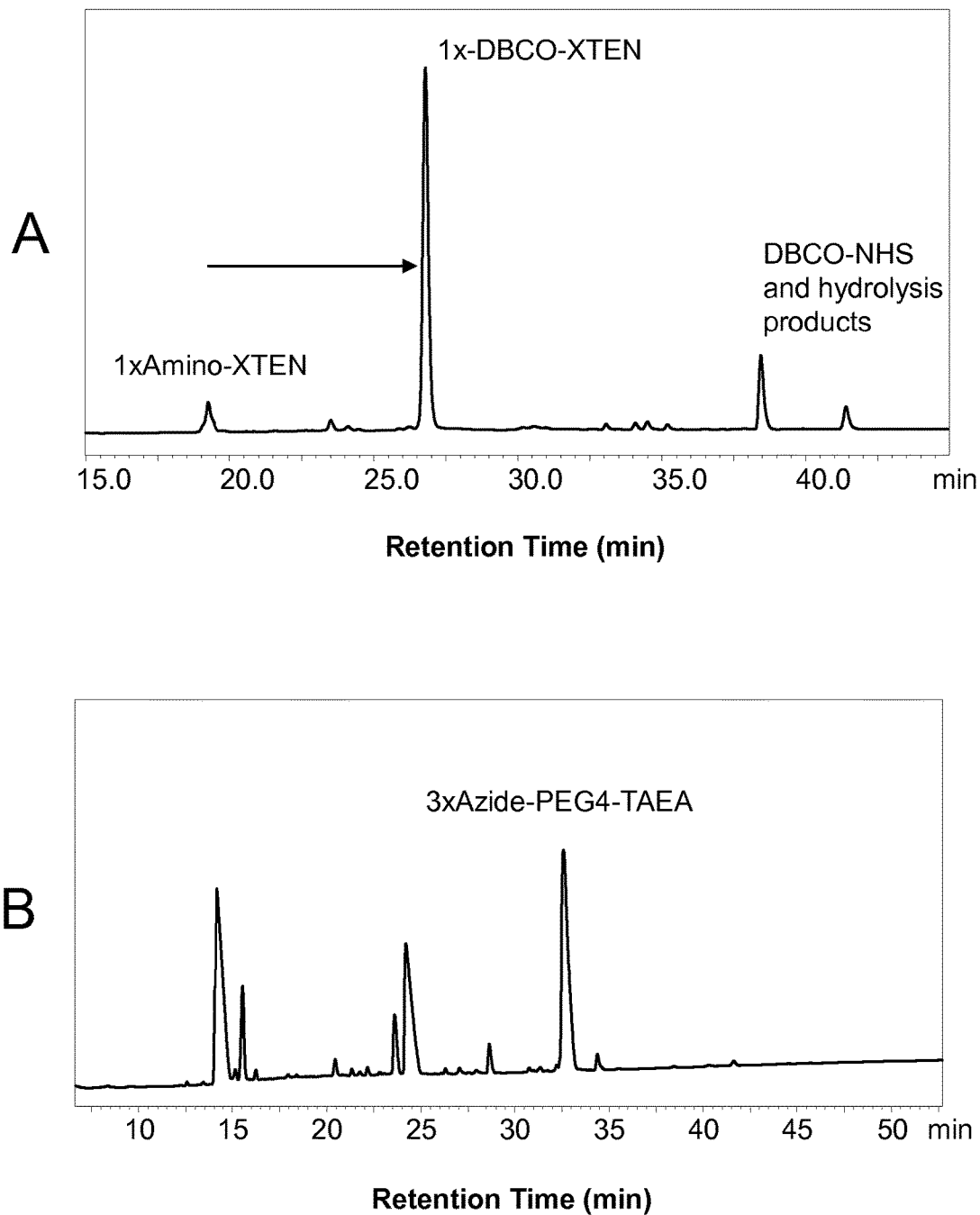
FIG. 114.

An aliquot of the protein 1×Amino-XTEN288 (XTEN_AE288(Am1)) was prepared as a 758 µM (20 mg/ml) solution in 20 mM HEPES, pH 7.0, 50 mM NaCl. 2 ml of protein was mixed with 0.1 ml 1M HEPES pH 8.0 and 0.152 ml of 50 mM DBCO-Sulfo-NHS (Click Chemistry Tools, cat # A124) dissolved in anhydrous DMF to link the DBCO group to the N-terminal amino group of the XTEN. The reaction mixture was incubated for 2 hours at 25° C. and analyzed by analytical RP-HPLC (FIG. 114A). The reaction mixture was diluted to 15 mL with 0.01% TFA and pH adjusted to ~3 using 10% TFA solution. The protein solution was divided into two equal parts and each fraction was loaded on a preparative C4 RP-HPLC column Vydac C4 250×10 mm (Grace Davison Discovery Sciences, cat. #214TP510). The protein was eluted with a 180 ml linear 5-50% gradient of acetonitrile in 0.01% TFA at 2 ml/min flow rate. Fractions containing 1×DBCO-XTEN288 were adjusted to pH~7 with 1 M HEPES pH 8 and were concentrated by vacuum evaporation.

2. Synthesis of 3×Azide-PEG4-TAEA

Tris(2-aminoethyl)amine (TAEA, Sigma Aldrich, cat. #225630) was diluted in anhydrous DMF to the final concentration 200 mM. Azido-PEG4-NHS ester (Click Chemistry Tools, cat. # AZ103) was dissolved in anhydrous DMF to the final concentration 1 M. Azido-PEG4-NHS was mixed in 5-fold molar excess with Tris(2-aminoethyl)amine and incubated at 25° C. for 1 hour. 3×Azide-PEG4-TAEA was purified using C18 RP-HPLC using Phenomenex Jupiter C18 5 u 300 Å 150×4.60 mm column, buffer A 0.1% TFA in water, buffer B 0.1% TFA in acetonitrile, flow rate 1 ml/min, gradient 5 to 50% B in 45 min. Chromatographic peaks were collected and analyzed by MALDI-TOF MS and ESI-MS to detect the product with MW of 966 Da. 3×Azide-PEG4-TAEA was identified as a peak with retention time 33 min (FIG. 114B). The fraction was neutralized using 1M HEPES pH 8.0 and concentrated by vacuum evaporation.

3. Synthesis of the Trimeric XTEN Conjugate

Figure 115:
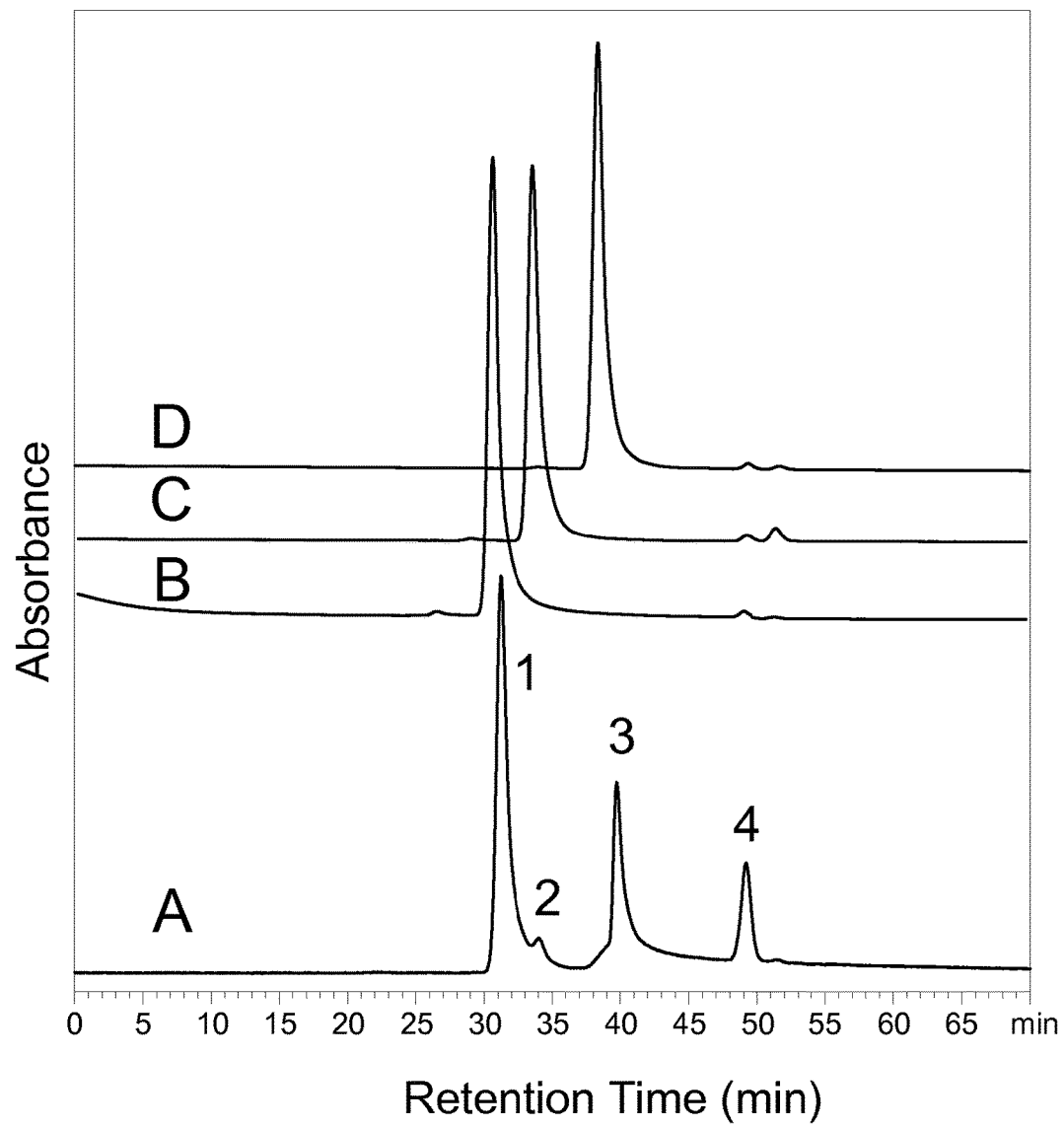
FIG. 115 shows the SEC-HPLC analysis, as described in Example 66, of the reaction products between 3×Azide-PEG4-TAEA and 1×DBCO-XTEN_288: (trace A) conjugation mixture: peak 1—trimeric XTEN, peak 2—dimeric XTEN, peak 3—unreacted monomeric XTEN, peak 4—low molecular weight compounds; (trace B) linear XTEN_864 control; (trace C) linear XTEN576 control; (trace D) linear XTEN_288 control.

1×DBCO-XTEN288 was prepared as a 7.85 mg/ml (293 uM) solution in 20 mM HEPES, pH 7.0, 50 mM NaCl. 3×Azide-PEG4-TAEA was RP-HPLC purified and formulated in the same buffer. A concentration of the synthesized linker was not determined, and 1×DBCO-XTEN288 and 3×Azide-PEG4-TAEA were mixed empirically in various ratios and incubated at 25° C. for 4 hours. Conjugation products were analyzed using SEC-HPLC (Phenomenex BioSep-SEC-s4000 600×7.80 mm, buffer: 50 mM Sodium Phosphate pH 6.5, 300 mM NaCl, flow rate 0.5 ml/min, isocratic elution for 70 min). Linear XTEN_288, XTEN_576 and XTEN_864 were analyzed under the same conditions to identify reaction products (FIG. 115). Peak 1 eluted at 30.5 min, the same time as XTEN_864 and was identified as a trimer of XTEN288. Peak 2 eluted at 34 min, the same time as XTEN_576 and was identified as a dimer of XTEN_288. Peak 3 eluted at 39 min, the same time as XTEN_288 and was identified as XTEN_288 precursor. Peak 4 corresponded to low molecular weight compounds and was not included into quantitation of XTEN species. The yield of the trimeric XTEN conjugate under the optimized protein/linker ratio was 57%. Essentially identical retention times for trimeric conjugate 3×XTEN_288 and linear molecule XTEN_864 confirms the earlier observation that the apparent molecular weight and hydrodynamic radius of an XTEN protein is not dependent on its geometric configuration.

Example 67: Selective Cytotoxicity of 3×FA(γ),3×MMAE-XTEN on KB Cells

The ability to selectively target and kill cells bearing folate receptors was evaluated. Test articles of free MMAE, a non-targeting 3×MMAE-XTEN conjugate (XTEN linked to toxin) and the folate receptor-targeted 3×FA(γ),3×MMAE-XTEN conjugate were evaluated in a CellTiter-Glo anti-proliferation assay using the folate receptor-positive KB cell line. As culture media contain high folic acid content, KB cells were grown in folic acid-free media containing 10% heat-inactivated fetal calf serum at 37° C., 5% C02 for at least 7 days prior to the commencement of the cell viability experiment, This medium was also utilized for the execution of the experiment. In brief, KB cells were plated at 10,000 cells per well onto a 96-well microtiter assay plate. KB cells were allowed to adhere to the plate by an overnight incubation at 37° C., 5% CO2. The spent media was then removed and wells designated to contain folic acid competitor received assay medium containing folic acid, while wells not designated to have folic acid competitor received assay medium only. The plate was incubated for 30 min at 37° C., 5% CO2 before the assay media was aspirated and plate washed with assay media. Free MMAE, 3×MMAE-XTEN and 3×FA(γ),3×MMAE-XTEN in the presence or absence of folic acid competitor was then added at an appropriate range of doses. The plate was then further incubated for 2-4 h at 37° C., 5% CO2. Media was then removed, the plate washed and fresh media introduced and the plate was allowed to incubate for an additional 48-72 h. After the appropriate incubation period, CellTiter-Glo reagent was added and the plate was read on a luminometer. The IC50 of each test article was determined using a 4 parameter logistic curve fit using GraphPad Prism.

Figure 116:
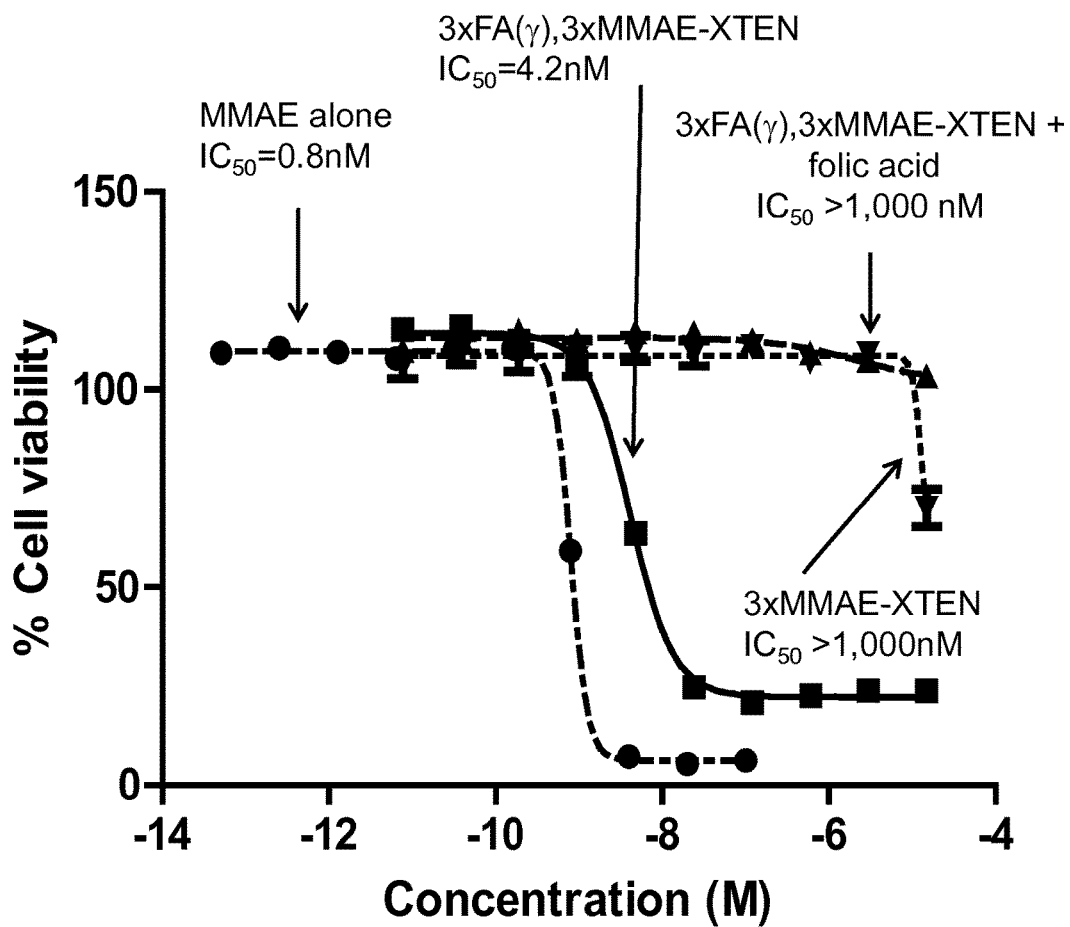
FIG. 116 shows results of a killing assay demonstrating selective cytotoxicity of 3×FA(γ),3×MMAE-XTEN on KB cells, as described in Example 69. The inhibitory dose response curves are shown for the groups of free MMAE (filled circles); 3×MMAE-XTEN (filled, inverted triangles) and 3×FA(γ),3×MMAE-XTEN in the presence (filled triangles) and absence (filled squares) of folic acid competitor on KB cells.

Results: As shown in FIG. 116, free MMAE drug moiety shows highly potent killing of KB cells, with an IC50 of 0.8 nM, while 3 copies of MMAE conjugated to non-targeting XTEN resulted in at least a 3 log reduction in cell killing (IC50>1,000 nM). Significantly, the addition of 3 copies of folate targeting domains to the 3×MMAE-XTEN conjugate restored the cell killing, with an IC 50 of 4.2 nM; a level of activity close to that observed for free MMAE. Of equal importance, the introduction of folic acid as a competitor to the targeted conjugate impaired the observed cell killing activity of 3×FA(γ),3×MMAE-XTEN on the KB cell line. This reduction from potent cell killing of the folate-XTEN drug conjugate (from 4.2 nM to >1,000 nM) supports the conclusion that the detected cell toxicity was, under the experimental conditions, facilitated by use of the folate as the targeting mechanism for the drug conjugate against the KB cell line.

Example 68: In Vitro Cell-Based Screening of Folate-XTEN-Drug Conjugates for Activity and Specificity The ability to selectively target and kill cells bearing folate receptors using targeted folate-XTEN-drug conjugates is evaluated using an in vitro-based screening and selectivity assay.

Each folate-XTEN-drug conjugate, its corresponding non-targeting XTEN-drug molecule and respective free drug control will be tested in a CellTiter-Glo anti-proliferation assay against a panel of folate receptor positive and negative cell lines. Choice of cell lines is based on relevance to proposed clinical application and includes KB, IGROV, SK-OV-3, HeLa, LoVo, SW620, Madison 109, A549, A375, LS-174T, HT-29, 4T1, SK-BR-3. As culture media contain high folic acid content, cells will be grown and assay performed in folic acid free-media containing 5-10% heat-inactivated fetal calf serum (FCS) at 37° C., 5% $CO_2$. Heat-inactivated FCS contains endogenous level of folic acid sufficient for folate receptor expressing cells to survive and proliferate. Appropriate assay conditions including optimal cell density and incubation time are pre-determined in folate-free media containing 5-10% FCS using the respective free drug as control. Folate-XTEN-drug conjugates are then tested as follows: cells in log-phase are collected, counted and plated at pre-determined cell density onto each well of a 96-well microtiter assay plate. Adherent cells are allowed to attach to the plate by an overnight incubation at 37° C., 5% $CO_2$. Folate-XTEN-drug conjugates and corresponding controls are introduced in a dose range in duplicates and plate incubated for an additional 2 to 5 days. Alternatively, cells can also be pulsed with folate-XTEN-drug conjugates and corresponding controls for 2-6 h, washed, fresh media introduced and allowed to incubate for an additional 48-72 h. After the appropriate incubation period, CellTiter-Glo reagent is added to each well, mixed for 2 minute on an orbital shaker. Plate is then centrifuged at 90 g and incubated at room temperature for an additional 10 minutes to stabilize the luminescent signal. Luminescence signals are then read on a luminometer & $IC_{50}$s (half maximal inhibitory concentration) calculated with GraphPad Prism or equivalent software. Quantitative comparisons of $IC_{50}$s will enable ranking of the compounds' activity for inhibition of cell growth and selectivity against folate receptor positive versus negative cell lines.

It is expected that the results would support the finding that the folate-XTEN-drug conjugates will show highly selective potent killing on folate receptor positive cells but not on folate receptor negative cells. This will be in contrast to the free drug moiety whereby no discrimination in the strong cytotoxicity is expected between folate receptor positive and negative cell lines. The XTEN-drug control is expected to yield poor cytotoxic activity. The folate-XTEN-drug conjugate with the most favorable activity and cell line selectivity relative to controls will be further verified for folate receptor association by the addition of free competitive folic acid in the assay and demonstrating impaired folate-XTEN-drug cytotoxicity.

Example 69: In Vitro Cell-Based Screening of LHRH-XTEN-Drug Conjugates for Activity and Specificity The ability to selectively target and kill cells bearing LHRH receptors using targeted LHRH-XTEN-drug conjugates is evaluated using an in vitro-based screening and selectivity assay. Each LHRH-XTEN-drug conjugate, its corresponding non-targeting XTEN-drug molecule and respective free drug control are tested in a CellTiter-Glo anti-proliferation assay against a panel of LHRH receptor positive and negative cell lines. Choice of cell lines is based on relevance to proposed clinical application and includes MCF-7, MDA-MB-231, HCC1806, HCC1937, OV-1063, EFO-21, EFO-27, NIH:OVCAR-3, BG-1, HEC-1A, HEC-1B, Ishikawa, KLE, AN-3-CA, MiaPaCa, Panc-1, rat Dunning R-3327-H, PC-82, MDA-PCa-2b, C4-2 (derivative of LNCaP), A549, A2780, UCI-107, SK-OV-3, SW 626, MFE-296. Appropriate assay conditions, including optimal cell density and incubation time, are pre-determined using the respective free drug as control. LHRH-XTEN-drug conjugates are tested as follows: cells in log-phase are collected, counted and plated at pre-determined cell density onto each well of a 96-well microtiter assay plate. Adherent cells are allowed to attach to the plate by an overnight incubation at 37° C., 5% CO2. LHRH-XTEN-drug conjugates and corresponding controls are introduced in a dose range in duplicates and plate incubated for an additional 2 to 5 days depending on cell lines used. After the appropriate incubation period, CellTiter-Glo reagent is added to each well, mixed for 2 minute on an orbital shaker. Plate is then centrifuged at 90×g and incubated at room temperature for an additional 10 minutes to stabilize the luminescent signal. Luminescence signals are then read on a luminometer & IC50s (half maximal inhibitory concentration) are calculated with GraphPad Prism or equivalent software. Quantitative comparisons of IC50s will enable ranking of the compounds' activity for inhibition of cell growth and selectivity against LHRH receptor positive versus negative cell lines.

It is expected that the results would support the finding that the LHRH-XTEN-drug conjugates will show highly-selective and potent killing of LHRH receptor positive cells but not on LHRH receptor-negative cells. This will be in contrast to the free drug moiety whereby no discrimination in the strong cytotoxicity is expected between LHRH receptor positive and negative cell lines. The XTEN-drug control without the LHRH targeting moiety is expected to yield poor cytotoxic activity. The LHRH-XTEN-drug conjugate with the most favorable activity and cell line selectivity relative to controls are further verified for LHRH receptor association by the addition of free competitive LHRH peptide in the assay and demonstrating impaired LHRH-XTEN-drug cytotoxicity.

Example 69: In Vitro Serum Stability of LHRH-XTEN-Drug Conjugates

As a measure of drug linkage stability, LHRH-XTEN-drug conjugates are incubated independently in normal human, cynomolgus monkey and rodent plasma at 37° C. for up to 2 weeks with an aliquot removed at periodic interval and stored at −80° C. till analysis. The stability of LHRH-XTEN-drug conjugate can be assessed either by the amount of free drug released or the integrity of the LHRH-XTEN-drug conjugate over time. Free drug is quantitated with RP-HPLC and/or LC-MS/MS whereas the amount of intact LHRH-XTEN-drug conjugate is determined by a XTEN/drug and/or LHRH/drug ELISA. For RP-HPLC analysis, plasma samples are treated with organic solvents such as acetonitrile or acetone to precipitate proteins. Soluble fractions are evaporated in vacuum, redissolved in loading solutions and analyzed by RP-HPLC. Analytes are detected by UV absorption at wavelength specific for a particular drug. For example, doxorubicin is detected at 480 nm. Calibration standards are prepared by adding known amounts of free drug to corresponding plasma type and are treated in parallel with experimental samples. For LC-MS/MS analysis, plasma samples are treated with organic solvents such as acetonitrile or acetone to precipitate proteins. Soluble fractions are evaporated in vacuum, redissolved in loading solutions and analyzed by RP-HPLC. Analytes are in-line detected and quantitated by triple quadrupole tandem mass spectrometry. Parental ion-daughter ion pairs are determined experimentally for each drug. Calibration standards are prepared by adding known amounts of free drug to corresponding plasma type and is treated in parallel with experimental samples. For quantitative ELISA, optimal concentrations of antibodies for LHRH-XTEN-drug conjugate in the ELISAs are determined using criss-cross serial dilution analysis. An appropriate capture antibody recognizing one component of the conjugate is coated onto a 96-well microtiter plate by an overnight incubation at 4° C. The wells are blocked, washed and serum stability samples added to the wells, each at varying dilutions to allow optimal capture of the LHRH-XTEN-drug conjugate by the coated antibody. After washing, detection antibody recognizing another component of the conjugate is added and allowed to bind to the conjugate captured on the plate. Wells are then washed again and either streptavidin-horseradish peroxidase (complementary to biotinylated version of detection antibody) or an appropriate secondary antibody-horseradish peroxidase (complementary to non-biotinylated version of detection antibody) is then added. After appropriate incubation and a final wash step, tetramethylbenzidine (TMB) substrate is added and plate read at 450 nM. Concentrations of intact conjugate are then calculated for each time point by comparing the colorimetric response to a calibration curve prepared with LHRH-XTEN-drug in the relevant plasma type. The t½ of the conjugate in human, cyno and mouse serum is then defined using linear regression analysis of the log concentrations vs. time.

Example 70: In Vitro Serum Stability of Folate-XTEN-Drug Conjugates

As a measure of drug linkage stability, folate-XTEN-drug conjugates are incubated independently in normal human, cynomolgus monkey and rodent plasma at 37° C. for up to 2 weeks with an aliquot removed at periodic interval and stored at −80° C. till analysis. The stability of folate-XTEN-drug conjugate can be assessed either by the amount of free drug or the integrity of the folate-XTEN-drug conjugate over time. Presence of free drug is quantitated with HPLC, LC-MS/MS and/or with the anti-proliferation assay as described in the relevant section above. The amount of intact folate-XTEN-drug conjugate is determined by a XTEN/drug and/or folate/drug ELISA. For RP-HPLC analysis, plasma samples are treated with organic solvents such as acetonitrile or acetone to precipitate proteins. Soluble fractions are evaporated in vacuum, redissolved in loading solutions and analyzed by RP-HPLC. Analytes are detected by UV absorption at wavelength specific for a particular drug. For example, doxorubicin is detected at 480 nm. Calibration standards are prepared by adding known amounts of free drug to corresponding plasma type and is treated in parallel with experimental samples. For LC-MS/MS analysis, plasma samples are treated with organic solvents such as acetonitrile or acetone to precipitate proteins. Soluble fractions are evaporated in vacuum, redissolved in loading solutions and analyzed by RP-HPLC. Analytes are in-line detected and quantitated by triple quadrupole tandem mass spectrometry. Parental ion-daughter ion pairs are determined experimentally for each drug. Calibration standards are prepared by adding known amounts of free drug to corresponding plasma type and is treated in parallel with experimental samples. When using the anti-proliferation assay as a detection method for the presence of de-conjugated free drug, folate receptor positive or negative cell line could be employed. Folic acid inhibitor is added when assessment is performed in receptor positive cell line and not required when done in receptor negative cell line. In either receptor cell type, increasing concentration of de-conjugated free drug contributes to increased cell toxicity. For quantitative ELISA, optimal concentrations of antibodies for folate-XTEN-drug conjugate in the ELISAs are determined using criss-cross serial dilution analysis. An appropriate capture antibody recognizing one component of the conjugate is coated onto a 96-well microtiter plate by an overnight incubation at 4° C. The wells are blocked, washed and serum stability samples added to the wells, each at varying dilutions to allow optimal capture of the folate-XTEN-drug conjugate by the coated antibody. After washing, detection antibody recognizing another component of the conjugate is added and allowed to bind to the conjugate captured on the plate. Wells are then washed again and either streptavidin-horseradish peroxidase (complementary to biotinylated version of detection antibody) or an appropriate secondary antibody-horseradish peroxidase (complementary to non-biotinylated version of detection antibody) is then added. After appropriate incubation and a final wash step, tetramethylbenzidine (TMB) substrate is added and plate read at 450 nM. Concentrations of intact conjugate are then calculated for each time point by comparing the colorimetric response to a calibration curve prepared with folate-XTEN-drug in the relevant plasma type. The t½ of the conjugate in human, cyno and mouse serum is then defined using linear regression analysis of the log concentrations vs. time.

Example 71: In Vivo and Ex Vivo Imaging of LHRH-XTEN-Cy5.5 Conjugate

A Cy5.5 fluorescent tagged LHRH-XTEN conjugate molecule is used as a surrogate to investigate the targeting and biodistribution efficiency of LHRH-XTEN-drug conjugates.

Experiments are carried out in nude mice bearing subcutaneous grown xenografts of LHRH receptor positive tumor cells using in vivo, followed by ex vivo, fluorescence imaging with IVIS 50 optical imaging system (Caliper Life Sciences, Hopkinton, Mass.). In brief, female nu/nu mice bearing LHRH receptor positive tumor cells are given a single intravenously injection of high or low dose LHRH-XTEN-Cy5.5 and corresponding doses of non-targeting Cy5.5 tagged XTEN control. Whole body scans are acquired pre-injection and then at approximately 8, 24, 48 and 72 hours post-injection on live anesthetized animals using the IVIS 50 optical imaging system. After measuring the distribution of fluorescence in the entire animal at the last time point of 72 h, tumor and healthy organs including liver, lung, heart, spleen and kidneys are excised and their fluorescence registered and processed by the imaging system. Cy5.5 excitation (615-665 nm) and emission (695-770 nm) filters are selected to match the fluorescence agents' wavelengths. Small and medium binning of the CCD chip is used and the exposure time optimized to obtain at least several thousand counts from the signals that were observable in each mouse in the image and to avoid saturation of the CCD chip. To normalize images for quantification, a background fluorescence image is acquired using background excitation and emission filters for the Cy5.5 spectral region. The intensity of fluorescence is expressed by different colors with blue color reflecting the lowest intensity and red is indicative of the highest intensity.

Example 72: In Vivo and Ex Vivo Imaging of Folate-XTEN-Cy5.5 Conjugates

A Cy5.5 fluorescent tagged folate-XTEN molecule is used as a surrogate to investigate the targeting and biodistribution efficiency of folate-XTEN-drug conjugates. Experiments are carried out in nude mice bearing subcutaneous grown xenografts of folate receptor positive tumor cells using in vivo, followed by ex vivo, fluorescence imaging with IVIS 50 optical imaging system (Caliper Life Sciences, Hopkinton, Mass.). As culture media contain high folate content, folate receptor positive tumor cells to be transplanted onto these mice are grown in folate-free cell culture media containing 5-10% heat-inactivated FCS with no antibiotics. Similarly, normal rodent chow contains a high concentration of folic acid; nude mice used in this study are maintained on a folate-free diet 2 weeks prior to tumor implantation and for the duration of the imaging analysis to reduce serum folate concentration. Female nu/nu mice bearing folate receptor positive tumor cells are given a single intravenously injection of high or low dose folate-XTEN-Cy5.5 and corresponding doses of non-targeting Cy5.5 tagged XTEN control. Whole body scans are acquired pre-injection and then at approximately 8, 24, 48 and 72 hours post-injection on live anesthetized animals using the IVIS 50 optical imaging system. After measuring the distribution of fluorescence in the entire animal at the last time point of 72 h, tumor and healthy organs including liver, lung, heart, spleen and kidneys are excised and their fluorescence registered and processed by the imaging system. Cy5.5 excitation (615-665 nm) and emission (695-770 nm) filters are selected to match the fluorescence agents' wavelengths. Small and medium binning of the CCD chip is used and the exposure time optimized to obtain at least several thousand counts from the signals that were observable in each mouse in the image and to avoid saturation of the CCD chip. To normalize images for quantification, a background fluorescence image is acquired using background excitation and emission filters for the Cy5.5 spectral region. The intensity of fluorescence is expressed by different colors with blue color reflecting the lowest intensity and red is indicative of the highest intensity.

Example 73: Pharmacokinetic Analysis of LHRH-XTEN-Drug Conjugates

The in vivo pharmacokinetics of LHRH-XTEN-drug constructs is assessed using standard methods for protein compositions. Pharmacokinetics are assessed in multiple species, however mice, rats, cynomolgus monkeys, and dogs are preferred due to their common usage in predicting human pharmacokinetics. Compositions of LHRH-XTEN-drug constructs are provided in an aqueous buffer compatible with in vivo administration (for example: phosphate-buffered saline, Tris-buffered saline or Hepes-buffered saline). The compositions are administered at appropriate doses and via multiple routes: most preferably via intravenous or subcutaneous routes. Blood samples are collected at appropriate time points ranging from 0.08 to 504 hours, and processed into plasma. Plasma samples will then be analyzed for concentration of LHRH-XTEN-drug conjugates by one of a variety of methods including ELISA, HPLC and/or LC-MS/MS. ELISA analysis will be performed using a sandwich ELISA format that can recognize 2 components of the LHRH-XTEN-drug conjugate, for instance, XTEN/LHRH, XTEN/drug moiety, LHRH/drug moiety and/or XTEN/XTEN combinations. Typically antibody recognizing one component of the LHRH-XTEN-drug conjugate is coated onto wells of a 96-well microtiter plate. The wells are blocked, washed and plasma samples that have been collected at different time points are then added to the wells, each at varying dilutions, to allow capture of the conjugate by the coated antibody. Wells are then washed extensively, and bound protein detected using either a biotinylated antibody or an appropriate secondary antibody against the second LHRH-XTEN-drug conjugate component. Wells are then washed again and streptavidin-horseradish peroxidase (complementary to the biotinylated detection antibody) or a secondary antibody-horseradish peroxidase (complementary to a non biotinylated detection antibody) is then added. After appropriate incubation and a final wash step, tetramethylbenzidine (TMB) substrate is added and plate read at 450 nM. Concentrations of conjugate are then calculated for each time point by comparing the colorimetric response to a LHRH-XTEN-drug calibration curve. Pharmacokinetic parameters are calculated using the WinNonLin software package. For RP-HPLC analysis, plasma samples are treated with organic solvents such as acetonitrile or acetone to precipitate proteins. Soluble fractions are evaporated in vacuum, redissolved in loading solutions and analyzed by RP-HPLC. Analytes are detected by UV absorption at wavelength specific for a particular drug. For example, doxorubicin is detected at 480 nm. Calibration standards are prepared by adding known amounts of free drug to corresponding plasma type and are treated in parallel with experimental samples. For LC-MS/MS analysis, plasma samples are treated with organic solvents such as acetonitrile or acetone to precipitate proteins. Soluble fractions are evaporated in vacuum, redissolved in loading solutions and analyzed by RP-HPLC. Analytes are in-line detected and quantitated by triple quadrupole tandem mass spectrometry. Parental ion-daughter ion pairs are determined experimentally for each drug. Calibration standards are prepared by adding known amounts of free drug to corresponding plasma type and are treated in parallel with experimental samples. It is expected that the results would support the finding that addition of an XTEN to LHRH and drug moiety as a conjugate preparation will greatly increase the terminal half-life and enhance pharmacokinetic properties compared to targeting peptides and drug moiety not linked to XTEN. This in turn will translate into a less frequent, more convenient dosing regimen for such conjugates.

Example 74: Pharmacokinetic Analysis of Folate-XTEN-Drug Conjugates

The in vivo pharmacokinetics of folate-XTEN-drug constructs are assessed using standard methods for protein compositions. Pharmacokinetics are assessed in multiple species, however mice, rats, cynomolgus monkeys, and dogs are preferred due to their common usage in predicting human pharmacokinetics. As normal feed contains a high concentration of folic acid (example 6 mg/kg mouse chow), animals to be used in pharmacokinetic studies of folate conjugates are maintained on folate-free diet for 2 weeks prior to study initiation and for the duration of the study. Compositions of folate-XTEN-drug constructs are typically provided in an aqueous buffer compatible with in vivo administration (for example: phosphate-buffered saline, Tris-buffered saline or Hepes-buffered saline). The compositions would be administered at appropriate doses and via multiple routes: most preferably via intravenous or subcutaneous routes. Blood samples would be collected at appropriate time points ranging from 0.08 to 504 hours, and processed into plasma. Plasma samples will then be analyzed for concentration of folate-XTEN-drug conjugates by a variety of methods including ELISA, HPLC and/or LC-MS/MS. ELISA analysis are performed using a sandwich ELISA format that can recognize 2 components of the folate-XTEN-drug conjugate, for instance, XTEN/folate, XTEN/drug moiety, folate/drug moiety and/or XTEN/XTEN combinations. Typically antibody recognizing one component of the folate-XTEN-drug conjugate is coated onto wells of a 96-well microtiter plate. The wells are blocked, washed and plasma samples that have been collected at different time points are then added to the wells, each at varying dilutions, to allow capture of the conjugate by the coated antibody. Wells are then washed extensively, and bound protein detected using either a biotinylated antibody or an appropriate secondary antibody against the second LHRH-XTEN-drug conjugate component. Wells are then washed again and streptavidin-horseradish peroxidase (complementary to the biotinylated detection antibody) or a secondary antibody-horseradish peroxidase (complementary to a non biotinylated detection antibody) is then added. After appropriate incubation and a final wash step, tetramethylbenzidine (TMB) substrate is added and plate read at 450 nM. Concentrations of conjugate are then calculated for each time point by comparing the colorimetric response to a folate-XTEN-drug calibration curve. Pharmacokinetic parameters are calculated using the WinNonLin software package. For RP-HPLC analysis, plasma samples are treated with organic solvents such as acetonitrile or acetone to precipitate proteins. Soluble fractions are evaporated in vacuum, redissolved in loading solutions and analyzed by RP-HPLC. Analytes are detected by UV absorption at wavelength specific for a particular drug. For example, doxorubicin is detected at 480 nm. Calibration standards are prepared by adding known amounts of free drug to corresponding plasma type and are treated in parallel with experimental samples. For LC-MS/MS analysis, plasma samples are treated with organic solvents such as acetonitrile or acetone to precipitate proteins. Soluble fractions are evaporated in vacuum, redissolved in loading solutions and analyzed by RP-HPLC. Analytes are in-line detected and quantitated by triple quadrupole tandem mass spectrometry. Parental ion-daughter ion pairs are determined experimentally for each drug. Calibration standards are prepared by adding known amounts of free drug to corresponding plasma type and are treated in parallel with experimental samples. It is expected that the results would support the finding that addition of an XTEN to folate and drug moiety as a conjugate preparation will greatly increase the terminal half-life and enhance pharmacokinetic properties compared to targeting peptides and drug moiety not linked to XTEN. This in turn will translate into a less frequent, more convenient dosing regimen for such conjugates.

Example 75: In Vivo Efficacy and Toxicity Analysis of LHRH-XTEN-Drug Conjugates

LHRH-XTEN-drug conjugate is intended for targeted delivery of highly potent toxin to LHRH receptor positive tumor cells. As such, the in vivo pharmacologic activity of LHRH-XTEN-drug constructs can be assessed using human tumor cell expressing LHRH receptor transplanted onto nude mice. Prior to beginning the efficacy study, an initial assessment in nude mice is carried out to establish the maximum tolerated dose (MTD) of the LHRH-XTEN-drug candidates. The MTD, the highest dose that is tolerated by the animal for the study duration, will then be used to calculate the dose range for the efficacy and toxicity study in the standard xenograft model. Briefly, the MTD experiment are carried out with 5 mice per group evaluating the intravenous administration of LHRH-XTEN-drug conjugates at various dose level, interval and duration. The starting MTD dose and number of dose groups required are based on scientific literature, knowledge of the targeting LHRH moiety, the nature of the drug moiety conjugated, toxicological properties of closely related compounds, and data from the initial pharmacokinetic studies (see section above). Standard MTD parameters such as reduction in body weight, food and water consumption and signs of piloerection, hunched, behavior patterns, respiratory pattern, tremors, convulsions, prostration and self-mutilation is carefully monitored on a daily basis. The highest dose of LHRH-XTEN-drug that does not cause unacceptable toxicity is assigned as the MTD. The tumor xenograft study will include 3 to 4 dosing levels of LHRH-XTEN-drug conjugate and will depend on the results from the MTD study; with other parameters depending on the tumor cell line chosen. Example 69 describes examples of tumor lines that can be used in the xenograft study. Thus an appropriate number of LHRH receptor positive cells from the relevant human tumor line are injected subcutaneously and allowed to form tumors, the size of which is measured with calipers and the volume calculated as $0.5 \times L \times W^2$, where L=measurement of longest axis in millimeters and W=measurement of axis perpendicular to L in millimeters. Following randomization of mice containing tumor volume in the desired size range into groups of 8-10 animals, vehicle control, free drug control and LHRH-XTEN-drug conjugate are administered intravenously at the chosen doses and interval. Cessation or regression of tumor growth is determined through measuring the tumor size and hence volume at selected time points with calipers. Body weights and food consumption are measured every 1 to 2 days to assess gross toxicity. Survival of animals is monitored daily. At the end of the study, all animals are sacrificed and clinical pathology and histopathology on major organs are performed. Targeted cytotoxins are among the most promising strategies for the selective elimination of malignant cells. It is anticipated that the results would support the finding that the LHRH-XTEN-drug conjugate will produce an excellent therapeutic index as exhibited by potent efficacy and low systemic toxicity. In contrast, the non-LHRH targeted free drug dosed at equimolar doses will not only be less potent but more highly toxic. The vehicle control is expected to display uncontrolled tumor growth and severe toxicity.

Example 76: In Vivo Efficacy and Toxicity Analysis of Folate-XTEN-Drug Conjugates Folate-XTEN-drug conjugate is intended for targeted delivery of highly potent toxin to folate receptor positive tumor cells. As such, the in vivo pharmacologic activity of folate-XTEN-drug constructs can be assessed using human tumor cell expressing folate receptor xenograft onto nude mice. Prior to beginning the efficacy study, an initial assessment in nude mice are carried out to establish the maximum tolerated dose (MTD) of the folate-XTEN-drug candidates. The MTD, the highest dose that is tolerated by the animal for the study duration, will then be used to calculate the dose range for the efficacy and toxicity study in the standard xenograft model. As normal rodent chow contains a high concentration of folic acid (6 mg/kg chow), mice to be used in these studies are maintained on folate-free diet for 2 weeks prior to study initiation and for the duration of the study. The MTD experiment is carried out with 5 mice per group evaluating the intravenous administration of folate-XTEN-drug conjugates at various dose level, interval and duration. The starting MTD dose and number of dose groups required is based on scientific literature, knowledge of the targeting folate moiety, the nature of the drug moiety conjugated, toxicological properties of closely related compounds, and data from the initial pharmacokinetic studies (see section above). Standard MTD parameters such as reduction in body weight, food and water consumption and signs of piloerection, hunched, behavior patterns, respiratory pattern, tremors, convulsions, prostration and self-mutilation is carefully monitored on a daily basis. The highest dose of folate-XTEN-drug that does not cause unacceptable toxicity is assigned as the MTD. The tumor xenograft study will include 3 to 4 dosing levels of folate-XTEN-drug and will depend on the results from the MTD; with other parameters depending on the tumor cell line chosen. Example 69 describes examples of tumor lines that can be used in the xenograft study. To reduce folate content, folate receptor positive tumor cells to be transplanted onto nude mice are grown in folate-free cell culture media containing 5-10% heat-inactivated fetal calf serum with no antibiotics. Similarly, to reduce serum folate concentration, mice used in the xenograft studies are maintained on folate-free diet 2 weeks prior to tumor implantation and for the duration of the study. Thus an appropriate number of folate receptor positive cells from the relevant line are injected subcutaneously and allowed to form tumors, the size of which is measured with calipers and the volume calculated as $0.5 \times L \times W^2$, where L=measurement of longest axis in millimeters and W=measurement of axis perpendicular to L in millimeters. Following randomization of mice containing tumor volume in the desired size range into groups of 8-10 animals, vehicle control, free drug control and folate-XTEN-drug are administered intravenously at the chosen doses and interval. Cessation or regression of tumor growth is determined through measuring the tumor size and hence volume at selected time points with calipers. Body weights and food consumption are measured every 1 to 2 days to assess gross toxicity. Survival of animals is monitored daily. At the end of study, all animals are sacrificed and clinical pathology and histopathology on major organs are performed. Targeted cytotoxins are among the most promising strategies for the selective elimination of malignant cells. It is anticipated that targeted chemotherapeutic folate-XTEN-drug conjugate will be more effective and less toxic than free cytotoxic drug alone on folate receptor positive tumors.

Example 76: Clinical Applications of LHRH-XTEN-Drug Conjugates

Targeted chemotherapy is a modern approach aimed at increasing the efficacy of systemic chemotherapy and reducing its side effects. Brentuximab vedotin (Adcentris), approved for Hodgkin lymphoma and systemic anaplastic large cell lymphoma is a leading example of effective toxin-targeted therapy. LHRH is a peptide that functions in reproductive organs. Because its receptors are particularly concentrated on certain tumors but are not expressed in most normal tissue, LHRH receptor is an ideal target for selective destruction of malignant tumors. Indeed, ~52% of breast, ~80% of ovarian and endometrial, and ~85% of prostate cancer specimens is targetable via the LHRH receptor. Of note, LHRH-dependent therapies would be especially useful for triple negative breast tumors, which do not overexpress estrogen or progesterone receptors or HER2 and are therefore unsuitable for treatment with many available targeted drugs. Patients with advanced endometrial, ovarian, or prostate cancer often have particularly poor outcomes, as these malignancies can be prone to recurrence and/or resistant to current treatments. In support of this, clinical studies with AEZS-108, a targeted doxorubicin analog of LHRH, indicate that each of these cancer types is susceptible to LHRH-based therapies. Fusion of a XTEN carrying ≥1 copy of LHRH to a XTEN bearing ≥3 drug molecules to create a targeted peptide-drug conjugate is expected to have vastly improved therapeutic index and half-life that will enable dosing at levels way below MTD, reduce dosing frequency and cost (reduced drug required per dose).

Clinical evaluation of LHRH-XTEN-drug composition are conducted in patients suffering from advanced breast, endometrial, ovarian, and prostate or bladder cancers. Clinical trials are designed such that the efficacy and advantages of the LHRH-XTEN-drug conjugate can be verified in humans. Such studies in patients would comprise three phases. First, a Phase I safety and pharmacokinetics study is conducted to determine the maximum tolerated dose (MTD) and to characterize the dose-limiting toxicity, pharmacokinetics and preliminary pharmacodynamics in humans. These initial studies are performed in patients with metastatic or unresectable cancers and for which standard curative or palliative measures could not be used or were no longer effective or tolerated. To enhance treatment efficacy, LHRH receptor positive status would be an enrollment criteria; determined by immunohistochemistry of primary tumors or metastatic specimens and/or by LHRH-targeted molecular imaging agent. The scheme of the phase I study is to use single escalating doses of LHRH-XTEN-drug conjugate and measure the biochemical, PK, and clinical parameters. This would permit the determination of the MTD and establish the threshold and maximum concentrations in dosage and in circulating drug that constitute the therapeutic window to be used in subsequent Phase II and Phase III trials. It also defines potential toxicities and adverse events to be tracked in future studies.

Phase II clinical studies of human patients are independently conducted in LHRH receptor positive advanced (stage 3 or 4) or recurrent breast, endometrial, ovarian, and prostate or bladder cancer patients. The trial evaluates the efficacy and safety of LHRH-XTEN-drug conjugate alone and in combination with a current chemotherapy employed in that specific indication. Patients receive intravenously administered LHRH-XTEN-drug clinical candidate at a dose level and regimen pre-determined in Phase I with or without the standard chemo-agent. A control arm comprising of the chemo-agent plus placebo is included. The primary endpoint is response rate as defined by the Response Evaluation Criteria in Solid Tumors (RECIST). Secondary endpoints include safety and tolerability, time-to-progression and overall survival.

A phase III efficacy and safety study is structured to replicate or modify the phase II trial design in LHRH receptor positive advanced (resistant, recurrent) breast, endometrial, ovarian, and prostate or bladder cancer patients depending on the phase II clinical observations. Refinement of patient enrollment criteria, further patient stratification (example LHRH receptor expression level), dosage, regimen, status of standard chemo-agent etc. could be further adjusted. The primary endpoint is progression-free-survival, as measured by RECIST, in patients defined as LHRH receptor positive. The trial is statistically powered for overall survival as a secondary endpoint with projected enrollment in excess of 400 patients. Incidence of adverse events, serious adverse event and deaths is assessed.

It is anticipated that LHRH-XTEN-drug candidate will demonstrate anticancer activity without cardiotoxicity even in these highly-pretreated patient populations.

Example 76: Clinical Applications of Folate-XTEN-Drug Conjugates

Targeted chemotherapy is a modern approach aimed at increasing the efficacy of systemic chemotherapy and reducing its side effects. Brentuximab vedotin (Adcentris), approved for Hodgkin lymphoma and systemic anaplastic large cell lymphoma is a leading example of effective toxin targeted therapy. Folate, also known as folic acid, vitamin $B_9$, is a vital nutrient required by all living cells for nucleotide biosynthesis and function as cofactor in certain biological pathways. It is especially important in aiding rapid cell division and growth. As such, the folate receptor is a focus for the development of therapies to treat fast dividing malignancy in particular ovarian cancer and non-small cell lung carcinoma. Some ovarian tumor type is likely to recur after initial successes with surgery and platinum-based chemotherapy, to which the regrowth can become resistant to available therapies. While folate receptor expression is negligible in normal ovary, ~90% of epithelial ovarian cancers overexpress the folate receptor, as do many lung adenocarinomas, thereby opening the possibility of directed therapies. In support of this, clinical studies with EC-145, a targeted vinca alkaloid analog of folate, indicated that platinum-resistant ovarian cancer and non-small cell lung carcinoma are susceptible to folate-based therapies. Fusion of a XTEN carrying ≥1 copy of folate to a XTEN bearing ≥3 drug molecules to create a targeted peptide-drug conjugate is expected to have vastly improved therapeutic index and half-life that will enable dosing at levels way below maximum tolerated dose (MTD), reduce dosing frequency and cost (reduced drug required per dose).

Clinical evaluation of folate-XTEN-drug composition is conducted in patients with relapsed or refractory advanced tumors or specifically in patients suffering from platinum-resistant ovarian cancer and non-small cell lung carcinoma who have failed numerous chemotherapies. Clinical trials are designed such that the efficacy and advantages of the folate-XTEN-drug conjugate can be verified in humans. Such studies in patients would comprise three phases. First, a Phase I safety and pharmacokinetics study is conducted to determine the MTD and to characterize the dose-limiting toxicity, pharmacokinetics and preliminary pharmacodynamics in humans. These initial studies are performed in patients with relapsed or refractory advanced tumors and for which standard curative or palliative measures could not be used or were no longer effective or tolerated. To enhance treatment efficacy, folate receptor positive status is an enrollment criteria, determined by immunohistochemistry of primary tumors or metastatic specimens and/or by folate-targeted molecular imaging agent. The scheme of the phase I study is to use single escalating doses of folate-XTEN-drug conjugate and measure the biochemical, PK, and clinical parameters. This would permit the determination of the MTD and establish the threshold and maximum concentrations in dosage and in circulating drug that constitute the therapeutic window to be used in subsequent Phase II and Phase III trials. It also defines potential toxicities and adverse events to be tracked in future studies.

Phase II clinical studies of human patients are independently conducted in folate receptor positive platinum-resistant ovarian cancer patient population; non-small cell lung carcinoma patients having failed numerous chemotherapies; and patients suffering from relapsed or refractory advanced tumors. The trial evaluates the efficacy and safety of folate-XTEN-drug conjugate alone and in combination with a current chemotherapy employed in the specific indication. Patients receive intravenously administered folate-XTEN-drug conjugate at a dose level and regimen pre-determined in Phase I with or without the standard chemo-agent. A control arm comprising of the chemo-agent plus placebo is included. The primary endpoint is response rate as defined by the Response Evaluation Criteria in Solid Tumors (RECIST). Secondary endpoints would include safety and tolerability, time-to-progression and overall survival.

A phase III efficacy and safety study is structured to replicate or modify the phase II trial design in folate receptor positive platinum-resistant ovarian cancer patients; non-small cell lung carcinoma patients; and advanced tumor relapsed or refractory patients depending on the phase II clinical observations. Refinement of patient enrollment criteria, further patient stratification (example folate receptor expression level), dosage, regimen, status of standard chemo-agent etc., is further adjusted. The primary endpoint is progression-free-survival, as measured by RECIST, in patients defined as folate receptor positive. The trial will also be statistically powered for overall survival as a secondary endpoint with projected enrollment in excess of 400 patients. Incidence of adverse events, serious adverse event and deaths is also assessed.

It is anticipated that folate-XTEN-drug candidate will demonstrate anticancer activity without severe toxicity even in these highly pretreated patient populations.

US 10,172,953 B2

TABLE 52

XTEN-cleavage sequence-affinity tag Polypeptide Sequences

| Construct | Amino Acid Sequence | SEQ ID NO: |
|---|---|---|
| AC710 | APTTAGAGRPRPRPRPRPRPRPRPRPRPRPGRGSPGSPAGSPTSTEEGTSESATPESGP<br>GTSTEPSEGSAPGSPAGSPTSTEEGTSTEPSEGSAPGTSTEPSEGSAPGTSESATPESGP<br>GSEPATSGSETPGSEPATSGSETPGSPAGSPTSTEEGTSESATPESGPGTSTEPSEGSAP<br>GTSTEPSEGSAPGSPAGSPTSTEEGTSTEPSEGSAPGTSTEPSEGSAPGTSESATPESGP<br>GTSTEPSEGSAPGTSESATPESGPGSEPATSGSETPGTSTEPSEGSAPGTSTEPSEGSAP<br>GTSESATPESGPGTSESATPESGPGSPAGSPTSTEEGTSESATPESGPGSEPATSGSETP<br>GTSESATPESGPGTSTEPSEGSAPGTSTEPSEGSAPGTSTEPSEGSAPGTSTEPSEGSAP<br>GTSESATPESGPGTSTEPSEGSAPGSPAGSPTSTEEGTSTEPSEGSAPGTSESATPESGP<br>GSEPATSGSETPGTSESATPESGPGSEPATSGSETPGTSESATPESGPGTSTEPSEGSAP<br>GTSESATPESGPGSPAGSPTSTEEGSPAGSPTSTEEGSPAGSPTSTEEGTSESATPESGP<br>GTSTEPSEGSAPGTSESATPESGPGSEPATSGSETPGTSESATPESGPGSEPATSGSETP<br>GTSESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPESGP<br>GTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPSEGSAP<br>GRHHHHHHHH | 1149 |
| AC698 | ANTPVSGNLKVEFYNSNPSDTTNSINPQFKVTNTGSSAIDLSKLTLRYYYTVDGQKD<br>QTFWADHAAIIGSNGSYNGITSNVKGTFVKMSSSTNNADTYLEISFTGGTLEPGAHV<br>QIQGRFAKNDWSNYTQSNDYSFKSASQFVEWDQVTAYLNGVLVWGKEPGGSVVGS<br>GSGSGRGSPGSPAGSPTSTEEGTSESATPESGPGTSTEPSEGSAPGSPAGSPTSTEEGTS<br>TEPSEGSAPGTSTEPSEGSAPGTSESATPESGPGSEPATSGSETPGSEPATSGSETPGSP<br>AGSPTSTEEGTSESATPESGPGTSTEPSEGSAPGTSTEPSEGSAPGSPAGSPTSTEEGTS<br>TEPSEGSAPGTSTEPSEGSAPGTSESATPESGPGTSTEPSEGSAPGTSESATPESGPGSEP<br>ATSGSETPGTSTEPSEGSAPGTSTEPSEGSAPGTSESATPESGPGTSESATPESGPGSPA<br>GSPTSTEEGTSESATPESGPGSEPATSGSETPGTSESATPESGPGTSTEPSEGSAPGTSTE<br>PSEGSAPGTSTEPSEGSAPGTSTEPSEGSAPGTSTEPSEGSAPGTSTEPSEGSAPGSPAG<br>SPTSTEEGTSTEPSEGSAPTAEAAGKPGTAEAAGTSESATPESGPGSEPATSGSETPGT<br>SESATPESGPGSEPATSGSETPGTSESATPESGPGTSTEPSEGSAPGTSESATPESGPGSP<br>AGSPTSTEEGSPAGSPTSTEEGSPAGSPTSTEEGTSESATPESGPGTSTEPSEGSAPGTS<br>ESATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGTSESATPESGPGSP<br>AGSPTSTEEGSPAGSPTSTEEGTSTEPSEGSAPGTSESATPESGPGTSESATPESGPGTS<br>ESATPESGPGSEPATSGSETPGSEPATSGSETPGSPAGSPTSTEEGTSTEPSEGSAPGTS<br>TEPSEGSAPGSEPATSGSETPGTSESATPESGPGTSTEPSEGSAPGKATHHHHHHHH | 1150 |
| AC815 | KNPEQAEEQAEEQREETRPRPRPRPRPRPRPRPRPRPRPRPRPSASRSAGSPTAEAAGCGTA<br>EAAGSPAGSPTSTEEGTSESATPESGPGTSTEPSEGSAPGSPAGSPTSTEEGTSTEPSEG<br>SAPGTSTEPSEGSAPGTSESATPESGPGSEPATSGSETPGSEPATSGSETPGSPAGSPTS<br>TEEGTSESATPESGPGTSTEPSEGSAPGTSTEPSEGSAPGSPAGSPTSTEEGTSTEPSEGS<br>APGTSTEPSEGSAPGTSESATPESGPGTSTEPSEGSAPGTSESATPESGPGSEPATSGSE<br>TPGTSTEPSEGSAPGTSTEPSEGSAPGTSESATPESGPGTSTEPSEGSAPGSPAGSPTSTE<br>EGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGTSTEPSEGSAPGSPAGSPTSTEE<br>GTSTEPSEGSAPGTSESATPESGPGSEPATSGSETPGTSESATPESGPGSEPATSGSETP<br>GTSESATPESGPGTSTEPSEGSAPGTSESATPESGPGSPAGSPTSTEEGSPAGSPTSTEE<br>GSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEE<br>GTSESATPESGPGSEPATSGSETPGTSESATPESGPGSPAGSPTSTEEGSPAGSPTSTEE<br>GTSTEPSEGSAPGTSESATPESGPGTSESATPESGPGSEPATSGSETP<br>GSEPATSGSETPGSPAGSPTSTEEGTSTEPSEGSAPGTSTEPSEGSAPGSEPATSGSETP<br>GTSESATPESGPGTSTEPSEGSAPSASRSAHHHHHHHH | 1151 |
| AC816 | KNPEQAEEQAEEQREETRPRPRPRPRPRPRPRPRPRPRPRPRPSASRSAGSPTAEAAGCGTA<br>EAAGSPAGSPTSTEEGTSESATPESGPGTSTEPSEGSAPGSPAGSPTSTEEGTSTEPSEG<br>SAPGTSTEPSEGSAPGTSESATPESGPGSEPATSGSETPGSEPATSGSETPGSPAGSPTS<br>TEEGTSESATPESGPGTSTEPSEGSAPGTSTEPSEGSAPGSPAGSPTSTEEGTSTEPSEGS<br>APGTSTEPSEGSAPGTSESATPESGPGTSTEPSEGSAPGTSESATPESGPGSEPATSGSE<br>TPGTSTEPSEGSAPGTSTEPSEGSAPGTSESATPESGPGTSTEPSEGSAPGSPAGSPTSTE<br>EGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGTSTEPSEGSAPGSPAGSPTSTEE<br>GTSTEPSEGSAPTAEAAGCGTAEAAGTSESATPESGPGSEPATSGSETPGTSESATPES<br>GPGSEPATSGSETPGTSESATPESGPGTSTEPSEGSAPGTSESATPESGPGSPAGSPTST<br>EEGSPAGSPTSTEEGSPAGSPTSTEEGTSESATPESGPGTSTEPSEGSAPGTSESATPES<br>GPGSEPATSGSETPGTSESATPESGPGSEPATSGSETPGTSESATPESGPGTSTEPSEGS<br>APGSPAGSPTSTEEGTSESATPESGPGSEPATSGSETPGTSESATPESGPGSPAGSPTST<br>EEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGS<br>APGSEPATSGSETPGTSESATPESGPGTSTEPSEGSAPTAEAAGCGTAEAASASRSAH<br>HHHHHHH | 1152 |
| AC763 | KNPEQAEEQAEEQREETRPRPRPRPRPRPRPRPRPRPRPRPRPSASRSAGSPTAEAAGCGTA<br>EAAGTSESATPESGPGSEPATSGSETPGTSESATPESGPGTSTEPSEGSAPGTSESATPE<br>SGPGSPAGSPTSTEEGSPAGSPTSTEEGSPAGSPTSTEEGTSESATPESGPGTSTEPSEGS<br>APGTSESATPESGPGSEPATSGSETPGTSESATPESGPGSEPATSGSETPGTSESATPES<br>GPGTSTEPSEGSAPTAEAAGCGTAEAAGSPAGSPTSTEEGTSESATPESGPGSEPATSG | 1153 |

TABLE 52-continued

XTEN-cleavage sequence-affinity tag Polypeptide Sequences

| Construct | Amino Acid Sequence | SEQ ID NO: |
|---|---|---|
| | SETPGTSESATPESGPGSPAGSPTSTEEGSPAGSPTSTEEGTSTEPSEGSAPGTSESATPE SGPGTSESATPESGPGTSESATPESGPGSEPATSGSETPGSEPATSGSETPGSPAGSPTS TEEGTSTEPSEGSAPGTSTEPSEGSAPGSEPATSGSETPTAEAAGCGTAEAASASRSAH HHHHHHH | |
| AC767 | KNPEQAEEQAEEQREETRPRPRPRPRPRPRPRPRPRPRPSASRSAGSPTGPGSEPATSG SETPGTSESATPESGPGSEPATSGSETPGTSESATPESGPGTSTEPSEGSAPGSPAGSPTS TEEGTSESATPESGPGSEPATSGSETPGTSESATPESGPGSPAGSPTSTEEGSPAGSPTS TEEGTSTEPSEGSAPGTSESATPESGPGTSESATPESGPGSEPATSGS ETPGSEPATSGSETPGSPAGSPTSTEEGTSTEPSEGSAPGTSTEPSEGSAPGSEPATSGS ETPGTSESATPESGPGTSTEPSEGSAPSASRSAHHHHHHHH | 1154 |
| AC769 | KNPEQAEEQAEEQREETRPRPRPRPRPRPRPRPRPRPRPSASRSAGSPTAEAAGCGTA EAAPGSEPATSGSETPGTSESATPESGPGSEPATSGSETPGTAEAAGCGTAEAASTEPS EGSAPGTSESATPESGPGSPAGSPTSTEEGSPATAEAAGCGTAEAASPTSTEEGTSESA TPESGPGTSTEPSEGSAPGTSESATTAEAAGCGTAEAASETPGTSESATPESGPGSEPA TSGSETPGTSESATPESGTAEAAGCGTAEAAGSPAGSPTSTEEGTSESATPESGPGSEP ATSGSETPGTTAEAAGCGTAEAAAGSPTSTEEGSPAGSPTSTEEGTSTEPSEGSAPGTS ESTAEAAGCGTAEAATPESGPGTSESATPESGPGSEPATSGSETPGSEPATSGTAEAA GCGTAEAATEEGTSTEPSEGSAPGTSTEPSEGSAPGSEPATSGSETPTAEAAGCGTAE AASASRSAHHHHHHHH | 1155 |
| AC771 | KNPEQAEEQAEEQREETRPRPRPRPRPRPRPRPRPRPRPSASRSAGSPGSPAGSPTSTE EGTSESATPESGPGTSTEPSEGSAPGSPAGSPTSTEEGTSTEPSEGSAPGTSTEPSEGSA PGTSESATPESGPGSEPATSGSETPGSEPATSGSETPGSPAGSPTSTEEGTSESATPESGP GTSTEPSEGSAPGTSTEPSEGSAPGSPAGSPTSTEEGTSTEPSEGSAPGTSTEPSEGSAP GTSESATPESGPGTSTEPSEGSAPGTSESATPESGPGSEPATSGSETPGTSTEPSEGSAP GTSTEPSEGSAPGTSESATPESGPGTSESATPESGPGSPAGSPTSTEEGTSESATPESGP GSEPATSGSETPGTSESATPESGPGTSTEPSEGSAPGTSTEPSEGSAPGTSTEPSEGSAP GTSTEPSEGSAPGTSTEPSEGSAPGTSTEPSEGSAPGSPAGSPTSTEEGTSTEPSEGSAP TAEAAGCGTAEAAPGSEPATSGSETPGTSESATPESGPGSEPATSGSETPGTAEAAGC GTAEAASTEPSEGSAPGTSESATPESGPGSPAGSPTSTEEGSPATAEAAGCGTAEAASP TSTEEGTSESATPESGPGTSTEPSEGSAPGTSESATTAEAAGCGTAEAASETPGTSESA TPESGPGSEPATSGSETPGTSESATPESGTAEAAGCGTAEAAGSPAGSPTSTEEGTSES ATPESGPGSEPATSGSETPGTTAEAAGCGTAEAAAGSPTSTEEGSPAGSPTSTEEGTST EPSEGSAPGTSESTAEAAGCGTAEAATPESGPGTSESATPESGPGSEPATSGSETPGSE PATSGTAEAAGCGTAEAATEEGTSTEPSEGSAPGTSTEPSEGSAPGSEPATSGSETPTA EAAGCGTAEAASASRSAHHHHHHHH | 1156 |
| AC817 | KKQEQEEKKAEEQREETRPRPRPRPRPRPRPRPRPRPRPSASRSAGSPGSPAGSPTSTE EGTSESATPESGPGTSTEPSEGSAPGSPAGSPTSTEEGTSTEPSEGSAPGTSTEPSEGSA PGTSESATPESGPGSEPATSGSETPGSEPATSGSETPGSPAGSPTSTEEGTSESATPESGP GTESASRSAHHHHHHHH | 1157 |
| AC818 | KKQEQEEKKAEEQREETRPRPRPRPRPRPRPRPRPRPRPSASRSAGSPGSPAGSPTSTE EGTSESATPESGPGTSTEPSEGSAPGSPAGSPTSTEEGTSTEPSEGSAPGTSTEPSEGSA PGTSESATPESGPGSEPATSGSETPGSEPATSGSETPGSPAGSPTSTEEGTSESATPESGP GTSTEPSEGSAPGTSTEPSEGSAPGSPAGSPTSTEEGTSTEPSEGSAPGTSTEPSEGSAP GTSESATPESGPGTSTEPSEGSAPGTSESATPESGPGSEPATSGSETPGTSTEPSEGSAP GTSTEPSEGSAPGTSESATPESGPGTSESATPESGPGSPAGSPTSTEEGTSESATPESGP GSEPATSGSETPGTSESATPESGPGTSTEPSEGSAPGTSTEPSEGSAPGTSTEPSEGSAP GTSTEPSEGSAPGTSTEPSEGSAPGTSESATPESGPGSPAGSPTSTEEGTESASRSAHHH HHHHH | 1158 |
| AC780 | KKQEQEEKKAEEQREETRPRPRPRPRPRPRPRPRPRPRPSASRSAGSPTEEGTSESATP ESGPGSEPATSGSETPGTSESATPESGPGTSTEPSEGSAPGTSTEPSEGSAPGTSTEPSE GSAPGTSTEPSEGSAPGTSTEPSEGSAPGTSTEPSEGSAPGSPAGSPTSTEEGTSTEPSE GSAPGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAGSPT STEEGTSESATPESGPGTSTEPSEGSAPGTSESATPESGPGSEPATSGSETPGTSESATPE SGPGSEPATSGSETPGTSESATPESGPGTSTEPSEGSAPGSPAGSPTSTEEGTSESATPES GPGSEPATSGSETPGTSESATPESGPGSPAGSPTSTEEGSPAGSPTSTEEGTSTEPSEGS APGTSESATPESGPGTSESATPESGPGSPAGSPTSTEEGTSESATPESGPGSEPATSGSE TPGSPAGSPTSTEEGTSTEPSEGSAPGTSTEPSEGSAPGSEPATSGSETPGTSESATPES GPGTSTEPSEGSAPSASRSAHHHHHHHH | 1159 |
| AC785 | KKQEQEEKKAEEQREETRPRPRPRPRPRPRPRPRPRPRPSASRSAGSPTEGTSTEPSEG SAPGTSESTAEAAGCGTAEAATPESGPGTSESATPESGPGSEPATSGSETPGSEPATSG TAEAAGCGTAEAATEEGTSTEPSEGSAPGTSTEPSEGSAPGSEPATSGSETPTAEAAG CGTAEAASASRSAHHHHHHHH | 1160 |
| AC765 | KNPEQAEEQAEEQREETRPRPRPRPRPRPRPRPRPRPRPSASRSAGSPTGTSESATPES GPGSEPATSGSETPGTSESATPESGPGSEPATSGSETPGTSESATPESGPGTSTEPSEGS APGTSESATPESGPGSPAGSPTSTEEGSPAGSPTSTEEGSPAGSPTSTEEGTSESATPES GPGTSTEPSEGSAPGTSESATPESGPGSEPATSGSETPGTSESATPESGPGSEPATSGSE TPGTSESATPESGPGTSTEPSEGSAPGSPAGSPTSTEEGTSESATPESGPGSEPATSGSE | 1161 |

TABLE 52-continued

XTEN-cleavage sequence-affinity tag Polypeptide Sequences

| Construct | Amino Acid Sequence | SEQ ID NO: |
|---|---|---|
| | TPGTSESATPESGPGSPAGSPTSTEEGSPAGSPTSTEEGTSTEPSEGSAPGTSESATPES GPGTSESATPESGPGTSESATPESGPGSEPATSGSETPGSEPATSGSETPGSPAGSPTST EEGTSTEPSEGSAPGTSTEPSEGSAPGSEPATSGSETPTAEAAGCGTAEAASASRSAHH HHHHHH | |
| AC766 | KNPEQAEEQAEEQREETRPRPRPRPRPRPRPRPRPRPRPSASRSAGSPTGSEPATSGSE TPGTSESATPESGPGSEPATSGSETPGTSESATPESGPGTSTEPSEGSAPGTSESATPES GPGSPAGSPTSTEEGSPAGSPTSTEEGSPAGSPTSTEEGTSESATPESGPGTSTEPSEGS APGTSESATPESGPGSEPATSGSETPGTSESATPES GPGTSTEPSEGSAPTAEAAGCGTAEAAGSPAGSPTSTEEGTSESATPESGPGSEPATSG SETPGTSESATPESGPGSPAGSPTSTEEGSPAGSPTSTEEGTSTEPSEGSAPGTSESTAE AAGCGTAEAATPESGPGTSESATPESGPGSEPATSGSETPGSEPATSGSETPGSPAGSP TSTEEGTSTEPSEGSAPGTSTEPSEGSAPGSEPATSGSETPTAEAAGCGTAEAASASRS AHHHHHHHH | 1162 |
| AC768 | KNPEQAEEQAEEQREETRPRPRPRPRPRPRPRPRPRPRPSASRSAGSPTPGTSESATPES GPGSEPATSGSETPGTSESATPESGPGSEPATSGSETPGSPGTSTEPSEGS APGTSESATPESGPGSPAGSPTSTEEGSPAGSPTSTEEGSPAGSPTSTEEGTSESATPES GPGTSTEPSEGSAPGTSESATPESGPGSEPATSGSETPGTSESATPESGPGSEPATSGSE TPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESTAEAA GCGTAEAATPESGPGTSESATPESGPGSEPATSGSETPGSEPATSGTAEAAGCGTAEA ATEEGTSTEPSEGSAPGTSTEPSEGSAPGSEPATSGSETPTAEAAGCGTAEAASASRSA HHHHHHHH | 1163 |
| AC786 | KKQEQEEKKAEEQREETRPRPRPRPRPRPRPRPRPRPRPSASRSAGSPGSPAGSPTSTE EGTSESATPESGPGTSTEPSEGSAPGSPAGSPTSTEEGTSTEPSEGSAPGTSTEPSEGSA PGTSESATPESGPGSEPATSGSETPGSEPATSGSETPGSPAGSPTSTEEGTSESATPESGP GTSTEPSEGSAPGTSTEPSEGSAPGSPAGSPTSTEEGTSTEPSEGSAPGTSTEPSEGSAP GTSESATPESGPGTSTEPSEGSAPGTSESATPESGPGSEPATSGSETPGTSTEPSEGSAP GTSTEPSEGSAPGTSESATPESGPGTSESATPESGPGSPAGSPTSTEEGTSESATPESGP GSEPATSGSETPGTSESATPESGPGTSTEPSEGSAPGTSTEPSEGSAPGTSTEPSEGSAP GTSTEPSEGSAPGTSTEPSEGSAPGTSTEPSEGSAPGSPAGSPTSTEEGTSTEPSEGSAP GTSTEPSEGSAPGSEPATSGSETPGTSESATPESGPGSEPATSGSETPGTSESATPESGP GTSTEPSEGSAPGTSESATPESGPGSPAGSPTSTEEGSPAGSPTSTEEGSPAGSPTSTEE GTSESATPESGPGTSTEPSEGSAPGTSESATPESGPGSEPATSGSETPGTSESATPESGP GSEPATSGSETPGTSESATPESGPGTSTEPSEGSAPGSPAGSPTSTEEGTSESATPESGP GSEPATSGSETPGTSESATPESGPGSPAGSPTSTEEGSPGTSTEEGTSTEPSEGSAP GTSESATPESGPGTSESATPESGPGTSESATPESGPGSEPATSGSETPGSEPATSGSETP GSPAGSPTSTEEGTSTEPSEGSAPGTSTEPSEGSAPGSEPATSGSETPGTSESATPESGP GTESASRSAHHHHHHHH | 1164 |
| AC792 | KKQEQEEKKAEEQREETRPRPRPRPRPRPRPRPRPRPRPSASRSAGSPGSTSSTAESPG PGSTSSTAESPGPGCTSESPSGTAPGSTSSTAESPGPGSTSSTAESPGPGTSTPESGSASP GSTSCSPSGEAPGTSPSGESSTAPGSTSESPSGTAPGSTSESPSGTAPETSPSGESCTAPG STSASRSAHHHHHHHH | 1165 |
| AC793 | KKQEQEEKKAEEQREETRPRPRPRPRPRPRPRPRPRPRPSASRSAGSPGTPGSGTASSS PGSSTPSGATGSPGCAGSGTASSSPGSSTPSGATGSPGTPGSGTASSSPGSSTPSGATGS PGSSTCSGATGSPGSSPSASTGTGPGSSPSASTGTGPGASPGTSSTGSPGTPGSGTACSS PGSSSASRSAHHHHHHHH | 1166 |
| AC798 | KKQEQEEKKAEEQREETRPRPRPRPRPRPRPRPRPRPRPSASRSAGSPGSPAGSPTSTE EGTSESATPESGPGTSTEPSEGSAPGSPAGSPTSTEEGTSTEPSEGSAPGTSTEPSEGSA PGTSESATPESGPGSEPATSGSETPGSEPATSGSETPGSPAGSPTSTEEGTSESATPESGP GTSTEPSEGSAPGTSTEPSEGSAPGSPAGSPTSTEEGTSTEPSEGSAPGTSTEPSEGSAP GTSESATPESGPGTSTEPSEGSAPGTSESATPESGPGSEPATSGSETPGTSTEPSEGSAP GTSTEPSEGSAPGTSESATPESGPGTSESATPESGPGSPAGSPTSTEEGTSESATPESGP GSEPATSGSETPGTSESATPESGPGTSTEPSEGSAPGTSTEPSEGSAPGTSTEPSEGSAP GTSTEPSEGSAPGTSESATPESGPGSEPATSGSETPGTSESATPESGPGSEPATSGSETP GSPAGSPTSTEEGSPAGSPTSTEEGSPAGSPTSTEEGTSESATPESGPGTSTEPSEGSAP GTSESATPESGPGSEPATSGSETPGTSESATPESGP GSEPATSGSETPGTSESATPESGPGTSTEPSEGSAPGSPAGSPTSTEEGTSESATPESGP GSEPATSGSETPGTSESATPESGPGSPAGSPTSTEEGSPAGSPTSTEEGTSTEPSEGSAP GTSESATPESGPGTSESATPESGPGTSESATPESGPGSEPATSGSETPGSEPATSGSETP GSPAGSPTSTEEGTSTEPSEGSAPGTSTEPSEGSAPGSEPATSGSETPGTSESATPESGP GTESASKSAHHHHHHHH | 1167 |
| AC809 | KNPEQAEEQAEEQREETRPRPRPRPRPRPRPRPRPRPRPSASRSAGSPTGPGSEPATSG SETPGTSESATPESGPGSEPATSGSETPGTSESATPESGPGTSTEPSEGSAPGSPAGSPTS TEEGTSESATPESGPGSEPATSGSETPGTSESATPESGPGSPAGSPTSTEEGSPAGSPTS TEEGTSTEPSEGSAPGTSESATPESGPGTSESATPESGPGTSESATPESGPGSEPATSGS ETPGSEPATSGSETPGSPAGSPTSTEEGTSTEPSEGSAPGTSTEPSEGSAPGSEPATSGS ETPGTSESATPESGPGTSTACSEGSAPSASRSAHHHHHHHH | 1168 |

TABLE 52-continued

XTEN-cleavage sequence-affinity tag Polypeptide Sequences

| Construct | Amino Acid Sequence | SEQ ID NO: |
|---|---|---|
| AC810 | KNPEQAEEQAEEQREETRPRPRPRPRPRPRPRPRPRPRPSASRSAGSPTGPGSEPATSG SETPGTSESATPESGPGSEPATSGSETPGTSESATPESGPGTSTEPSEGSAPGSPAGSPTS TEEGTSESATPESGPGSEPATSGSETPGTSESATPESGPGSPAGSPTSTEEGSPAGSPTS TEEGTSTEPSEGSAPGTSESATPESGPGTSESATPESGPGTSESATPESGPGSEPATSGS ETPGSEPATSGSETPGSPAGSPTSTEEGTSTEPSEGSAPGTSTEPSEGSAPGSEPATSGS ETPGTSESATPESGPGTSTEPSEGSCASASRSAHHHHHHHH | 1169 |
| AC831 | KKQEQEEKKAEEQREETRPRPRPRPRPRPRPRPRPRPRPSASRSAGSPGSTSSTAESPG PGSTSSTAESPGPGSTSESPSGTAPGSTSSTAESPGPGSTSSTAESPGPGTSTPESGSASP GSTSESPSGTAPGTSPSGESSTAPGSTSESPSGTAPGSTSESPSGTAPGTSPSGESSTAPG STSESPSGTAPGSTSESPSGTAPGTSPSGESSTAPGSTSESPSGTAPGSTSESPSGTAPGS TSESPSGTAPGTSTPESGSASPGSTSESPSGTAPGTSTPESGSASPGSTSSTAESPGPGST SSTAESPGPGTSTPESGSASPGTSTPESGSASPGSTSESPSGTAPGTSTPESGSASPGTST PESGSASPGSTSESPSGTAPGSTSESPSGTAPGSTSESPSGTAPGSTSSTAESPGPGTSTP ESGSASPGTSTPESGSASPGSTSESPSGTAPGSTSESPSGTAPGTSTPESGSASPGSTSES PSGTAPGSTSESPSGTAPGTSTPESGSASPGTSPSGESSTAPGSTSSTAESPGPGTSPSGE SSTAPGSTSSTAESPGPGTSTPESGSASPGSTSESPSGTAPGSTSSTAESPGPGTSTPESG SASPGTSTPESGSASPGSTSSTAESPGPGTSPSGESSTAPGTSTPESGSASPGSTSESPSG TAPGSTSESPSGTAPGTSTPESGSASPGTSPSGESSTAPGSTSSTAESPGPGTSPSGESST APGSTSSTAESPGPGSTSSTAESPGPGTSPSGESSTAPGSTSESPSGTAPGSTSESPSGTA PGTSTPESGSASPGSTSESPSGTAPGSTSESPSGTAPGTSTPESGSASPGSTSESPSGTAP GSTSESPSGTAPGSTSESPSGTAPGSTSSTAESPGPGTSPSGESSTAPGTSSASRSAHHH HHHHH | 1170 |
| AC832 | KKQEQEEKKAEEQREETRPRPRPRPRPRPRPRPRPRPRPSASRSAGSPGASPGTSSTGS PGSSSPSASTGTGPGSSPSASTGTGPGTPGSGTASSSPGSSTPSGATGSPGSSPSASTGTG PGASPGTSSTGSPGTPGSGTASSSPGSSTPSGATGSPGTPGSGTASSSPGASPGTSSTGS PGASPGTSSTGSPGTPGSGTASSSPGSSTPSGATGSPGASPGTSSTGSPGTPGSGTASSS PGSSTPSGATGSPGSSPSASTGTGPGSSPSASTGTGPGSSTPSGATGSPGSSTPSGATGS PGASPGTSSTGSPGASPGTSSTGSPGASPGTSSTGSPGTPGSGTASSSPGASPGTSSTGS PGASPGTSSTGSPGASPGTSSTGSPGSSPSASTGTGPGTPGSGTASSSPGASPGTSSTGS PGASPGTSSTGSPGASPGTSSTGSPGSSTPSGATGSPGSSTPSGATGSPGASPGTSSTGS PGTPGSGTASSSPGSSTPSGATGSPGSSTPSGATGSPGSSTPSGATGSPGSSPSASTGTG PGASPGTSSTGSPGASPGTSSTGSPGTPGSGTASSSPGASPGTSSTGSPGASPGTSSTGS PGASPGTSSTGSPGASPGTSSTGSPGTPGSGTASSSPGSSTPSGATGSPGTPGSGTASSS PGSSTPSGATGSPGTPGSGTASSSPGSSTPSGATGSPGSSTPSGATGSPGSSPSASTGTG PGSSPSASTGTGPGASPGTSSTGSPGTPGSGTASSSPGSSTPSGATGSPGSSPSASTGTG PGSSPSASTGTGPGASPGTSSTGSPGASPGTSSTGSPGSSTPSGATGSPGSSPSASTGTG PGASPGTSSTGSPGSSPSASTGTGPGTPGSGTASSSPGSSTPSGATGSPGSSTPSGATGS PGASSASRSAHHHHHHHH | 1171 |
| AC819 | KKQEQEEKKAEEQREETRPRPRPRPRPRPRPRPRPRPRPSASRSAGSPGSCAGSPTSTE EGTSESACPESGPGTSTEPSEGSCPGSPAGSPTSTEEGTCTEPSEGSAPGTSTEPCSGSA PGTSESATPESCPGSEPATSGSETPGSCPATSGSETPGSPAGSCTSTEEGTSESATPESC PGTESASRSAHHHHHHHH | 1172 |
| AC820 | KNPEQAEEQAEEQREETRPRPRPRPRPRPRPRPRPRPRPSASRSAGSPTGCGSEPATSG SETPGTSESATPESGPGSEPATSGSETPGTSESATPESGPGTSTEPSEGSAPGSPAGSPTS TEEGTSESATPESGPGSEPATSGSETPGTSESATPESGPGSPAGSPTSTEEGSPAGSPTS TEEGTSCTPSEGSAPGTSESATPESGPGTSESATPESGPGTSESATPESGPGSEPATSGS ETPGSEPATSGSETPGSPAGSPTSTEEGTSTEPSEGSAPGTSTEPSEGSAPGSEPATSGS ETPGTSESATPESGPGTSTEPSCGSAPSASRSAHHHHHHHH | 1173 |
| AC821 | KNPEQAEEQAEEQREETRPRPRPRPRPRPRPRPRPRPRPSASRSAGSPTGCGSEPATSG SETPGTSESATPESGPGSEPATSGSCTPGTSESATPESGPGTSTEPSEGSAPGSPAGSPC STEEGTSESATPESGPGSEPATSGSETPGTSESCTPESGPGSPAGSPTSTEEGSPAGSPTS TEEGTSCTPSEGSAPGTSESATPESGPGTSESATPESGPGCSESATPESGPGSEPATSGS ETPGSEPATSGSETCGSPAGSPTSTEEGTSTEPSEGSAPGTSTEPSEGCAPGSEPATSGS ETPGTSESATPESGPGTSTEPSCGSAPSASRSAHHHHHHHH | 1174 |

SEQUENCE LISTING (1179 sequences)

SEQ ID NO: 1 - protein, 13 aa, Artificial Sequence
  Description of Artificial Sequence: Synthetic peptide
  MOD_RES (10)..(10): Ser or Arg
KNPEQAEEQXEET

SEQ ID NO: 2 - protein, 13 aa, Artificial Sequence
  Description of Artificial Sequence: Synthetic peptide
  MOD_RES (10)..(10): Ser or Arg
ANPEQAEEQXEET

SEQ ID NO: 3 - protein, 17 aa, Artificial Sequence
  Description of Artificial Sequence: Synthetic peptide
  MOD_RES (14)..(14): Ser or Arg
KNPEQAEEQAEEQXEET

SEQ ID NO: 4 - protein, 17 aa, Artificial Sequence
  Description of Artificial Sequence: Synthetic peptide
  MOD_RES (2)..(2): Lys or Asn
  MOD_RES (3)..(3): Lys, Asn, Thr, Gln, His, Pro, Glu, Asp, Ala, Arg or Ser
  MOD_RES (14)..(14): Ser or Arg
KXXEQAEEQAEEQXEET

SEQ ID NO: 5 - protein, 17 aa, Artificial Sequence
  Description of Artificial Sequence: Synthetic peptide
  MOD_RES (2)..(2): Lys or Asn
  MOD_RES (3)..(12): Lys, Asn, Thr, Gln, His, Pro, Glu, Asp, Ala, Arg or Ser
  MOD_RES (14)..(14): Ser or Arg
KXXXXXXXXXXXQXEET

SEQ ID NO: 6 - protein, 17 aa, Artificial Sequence
  Description of Artificial Sequence: Synthetic peptide
  MOD_RES (2)..(2): Lys or Asn
  MOD_RES (3)..(9): Lys, Asn, Thr, Gln, His, Pro, Glu, Asp, Ala, Arg or Ser
  MOD_RES (14)..(14): Ser or Arg
KXXXXXXXXAEEQXEET

SEQ ID NO: 7 - protein, 17 aa, Artificial Sequence
  Description of Artificial Sequence: Synthetic peptide
  MOD_RES (2)..(2): Lys or Asn
  MOD_RES (3)..(3): Lys, Asn, Thr, Gln, His, Pro, Glu, Asp, Ala, Arg or Ser
  MOD_RES (7)..(9): Lys, Asn, Thr, Gln, His, Pro, Glu, Asp, Ala, Arg or Ser
KXXEQEXXXAEEQREET

SEQ ID NO: 8 - protein, 17 aa, Artificial Sequence
  Description of Artificial Sequence: Synthetic peptide
  MOD_RES (2)..(2): Lys or Asn
  MOD_RES (3)..(3): Lys, Asn, Thr, Gln, His, Pro, Glu, Asp, Ala, Arg or Ser
  MOD_RES (7)..(9): Lys, Asn, Thr, Gln, His, Pro, Glu, Asp, Ala, Arg or Ser
  MOD_RES (13)..(17): Lys, Asn, Thr, Gln, His, Pro, Glu, Asp, Ala, Arg or Ser
KXXEQEXXXAEEXXXXX

SEQ ID NO: 9 - protein, 21 aa, Artificial Sequence
  Description of Artificial Sequence: Synthetic peptide
  MOD_RES (14)..(14): Ala or Ser
  MOD_RES (15)..(15): Lys, Gln or Glu
  MOD_RES (16)..(16): Ala or Ser
  MOD_RES (17)..(17): Lys, Gln or Glu
KKQEQEKEQAEEQXXXXREET

SEQ ID NO: 10 - protein, 25 aa, Artificial Sequence
  Description of Artificial Sequence: Synthetic peptide
  MOD_RES (14)..(14): Ala or Ser
  MOD_RES (15)..(15): Lys, Gln or Glu
  MOD_RES (16)..(16): Ala or Ser
  MOD_RES (17)..(17): Lys, Gln or Glu
  MOD_RES (18)..(18): Ala or Ser
  MOD_RES (19)..(19): Lys, Gln or Glu
  MOD_RES (20)..(20): Ala or Ser
  MOD_RES (21)..(21): Lys, Gln or Glu
KKQEQEKEQAEEQXXXXXXXXREET

SEQ ID NO: 11 - protein, 21 aa, Artificial Sequence
  Description of Artificial Sequence: Synthetic peptide
  MOD_RES (14)..(17): Any naturally-occurring L-amino acid
KKQEQEKEQAEEQXXXXREET

SEQ ID NO: 12 - protein, 42 aa, Artificial Sequence
  Description of Artificial Sequence: Synthetic polypeptide
  MOD_RES (2)..(2): Lys or Asn
  MOD_RES (3)..(42): Lys, Asn, Thr, Gln, His, Pro, Glu, Asp, Ala, Arg or Ser
  misc_feature (3)..(42): This region may encompass 10-40 residues
KXXXXXXXXXXXXXXXXXXXXXXXXXXXXXXXXXXXXXXXXX

SEQ ID NO: 13 - protein, 50 aa, Artificial Sequence
  Description of Artificial Sequence: Synthetic polypeptide
  MOD_RES (1)..(50): Lys, Asn, Thr, Gln, His, Pro, Glu, Asp, Ala, Arg or Ser
  misc_feature (1)..(50): This sequence may encompass 10-50 residues
XXXXXXXXXXXXXXXXXXXXXXXXXXXXXXXXXXXXXXXXXXXXXXXXXX

SEQ ID NO: 14 - protein, 37 aa, Artificial Sequence
  Description of Artificial Sequence: Synthetic polypeptide
  MOD_RES (2)..(2): Lys or Asn
  MOD_RES (14)..(14): Ala or Ser
  MOD_RES (15)..(15): Lys, Gln or Glu
  MOD_RES (16)..(16): Ala or Ser
  MOD_RES (17)..(17): Lys, Gln or Glu
  MOD_RES (18)..(18): Ala or Ser
  MOD_RES (19)..(19): Lys, Gln or Glu
  MOD_RES (20)..(20): Ala or Ser
  MOD_RES (21)..(21): Lys, Gln or Glu
  MOD_RES (22)..(22): Ala or Ser
  MOD_RES (23)..(23): Lys, Gln or Glu
  MOD_RES (24)..(24): Ala or Ser
  MOD_RES (25)..(25): Lys, Gln or Glu
  MOD_RES (26)..(26): Ala or Ser
  MOD_RES (27)..(27): Lys, Gln or Glu
  MOD_RES (28)..(28): Ala or Ser
  MOD_RES (29)..(29): Lys, Gln or Glu
  MOD_RES (30)..(30): Ala or Ser
  MOD_RES (31)..(31): Lys, Gln or Glu
  MOD_RES (32)..(32): Ala or Ser
  MOD_RES (33)..(33): Lys, Gln or Glu
  misc_feature (14)..(33): This region may encompass 0-10 "Xaa Xaa" repeating units
  MOD_RES (34)..(34): Ser or Arg
KXQEQEKEQAEEQXXXXXXXXXXXXXXXXXXXXXEET

SEQ ID NO: 15 - protein, 46 aa, Artificial Sequence
  Description of Artificial Sequence: Synthetic polypeptide
  MOD_RES (2)..(2): Lys or Asn
  MOD_RES (3)..(22): Lys, Asn, Thr, Gln, His, Pro, Glu, Asp, Ala, Arg or Ser
  misc_feature (3)..(22): This region may encompass 5-20 residues
  MOD_RES (23)..(23): Ala or Ser
  MOD_RES (24)..(24): Lys, Gln or Glu
  MOD_RES (25)..(25): Ala or Ser
  MOD_RES (26)..(26): Lys, Gln or Glu
  MOD_RES (27)..(27): Ala or Ser
  MOD_RES (28)..(28): Lys, Gln or Glu
  MOD_RES (29)..(29): Ala or Ser
  MOD_RES (30)..(30): Lys, Gln or Glu
  MOD_RES (31)..(31): Ala or Ser
  MOD_RES (32)..(32): Lys, Gln or Glu
  MOD_RES (33)..(33): Ala or Ser
  MOD_RES (34)..(34): Lys, Gln or Glu
  MOD_RES (35)..(35): Ala or Ser
  MOD_RES (36)..(36): Lys, Gln or Glu
  MOD_RES (37)..(37): Ala or Ser
  MOD_RES (38)..(38): Lys, Gln or Glu
  MOD_RES (39)..(39): Ala or Ser
  MOD_RES (40)..(40): Lys, Gln or Glu
  MOD_RES (41)..(41): Ala or Ser
  MOD_RES (42)..(42): Lys, Gln or Glu
  misc_feature (23)..(42): This region may encompass 0-10 "Xaa Xaa" repeating units
  MOD_RES (43)..(43): Ser or Arg
KXXXXXXXXXXXXXXXXXXXXXXXXXXXXXXXXXXXXXXXXXXEET

SEQ ID NO: 16 - protein, 36 aa, Artificial Sequence
  Description of Artificial Sequence: Synthetic polypeptide
  MOD_RES (2)..(2): Lys or Asn
  MOD_RES (3)..(22): Lys, Asn, Thr, Gln, His, Pro, Glu, Asp, Ala, Arg or Ser
  misc_feature (3)..(22): This region may encompass 5-20 residues
  MOD_RES (23)..(32): Any naturally-occurring L-amino acid
  misc_feature (23)..(32): This region may encompass 0-10 residues
  MOD_RES (33)..(33): Ser or Arg
KXXXXXXXXXXXXXXXXXXXXXXXXXXXXXXXXEET

SEQ ID NO: 17 - protein, 13 aa, Artificial Sequence
  Description of Artificial Sequence: Synthetic peptide
RPRPRPRPRPRPR

SEQ ID NO: 18 - protein, 6 aa, Artificial Sequence
  Description of Artificial Sequence: Synthetic 6xHis tag
HHHHHH

SEQ ID NO: 19 - protein, 23 aa, Artificial Sequence
  Description of Artificial Sequence: Synthetic peptide
RPRPRPRPRPRPRPRPRPRPRPR

SEQ ID NO: 20 - protein, 8 aa, Artificial Sequence
  Description of Artificial Sequence: Synthetic 8xHis tag
HHHHHHHH

SEQ ID NO: 21 - protein, 6 aa, Artificial Sequence
  Description of Artificial Sequence: Synthetic peptide
SASRSA

SEQ ID NO: 22 - protein, 6 aa, Artificial Sequence
  Description of Artificial Sequence: Synthetic peptide
SASKSA

SEQ ID NO: 23 - protein, 6 aa, Artificial Sequence
  Description of Artificial Sequence: Synthetic peptide
  MOD_RES (4)..(4): Arg or Lys
SASXSA

SEQ ID NO: 24 - protein, 5 aa, Artificial Sequence
  Description of Artificial Sequence: Synthetic peptide
  MOD_RES (3)..(3): Any amino acid
LPXTG

SEQ ID NO: 25 - protein, 6 aa, Artificial Sequence
  Description of Artificial Sequence: Synthetic peptide
HCKFWW

SEQ ID NO: 26 - protein, 12 aa, Artificial Sequence
  Description of Artificial Sequence: Synthetic peptide
GESPGGSSGSES

SEQ ID NO: 27 - protein, 12 aa, Artificial Sequence
  Description of Artificial Sequence: Synthetic peptide
GSEGSSGPGESS

SEQ ID NO: 28 - protein, 12 aa, Artificial Sequence
  Description of Artificial Sequence: Synthetic peptide
GSSESGSSEGGP

SEQ ID NO: 29 - protein, 12 aa, Artificial Sequence
  Description of Artificial Sequence: Synthetic peptide
GSGGEPSESGSS

SEQ ID NO: 30 - protein, 12 aa, Artificial Sequence
  Description of Artificial Sequence: Synthetic peptide
GSPAGSPTSTEE

SEQ ID NO: 31 - protein, 12 aa, Artificial Sequence
  Description of Artificial Sequence: Synthetic peptide
GSEPATSGSETP

SEQ ID NO: 32 - protein, 12 aa, Artificial Sequence
  Description of Artificial Sequence: Synthetic peptide
GTSESATPESGP

SEQ ID NO: 33 - protein, 12 aa, Artificial Sequence
  Description of Artificial Sequence: Synthetic peptide
GTSTEPSEGSAP

SEQ ID NO: 34 - protein, 12 aa, Artificial Sequence
  Description of Artificial Sequence: Synthetic peptide
GSTSESPSGTAP

SEQ ID NO: 35 - protein, 12 aa, Artificial Sequence
  Description of Artificial Sequence: Synthetic peptide
GTSTPESGSASP

SEQ ID NO: 36 - protein, 12 aa, Artificial Sequence
  Description of Artificial Sequence: Synthetic peptide
GTSPSGESSTAP

SEQ ID NO: 37 - protein, 12 aa, Artificial Sequence
  Description of Artificial Sequence: Synthetic peptide
GSTSSTAESPGP

SEQ ID NO: 38 - protein, 12 aa, Artificial Sequence
  Description of Artificial Sequence: Synthetic peptide
GTPGSGTASSSP

SEQ ID NO: 39 - protein, 12 aa, Artificial Sequence
  Description of Artificial Sequence: Synthetic peptide
GSSTPSGATGSP

SEQ ID NO: 40 - protein, 12 aa, Artificial Sequence
  Description of Artificial Sequence: Synthetic peptide
GSSPSASTGTGP

SEQ ID NO: 41 - protein, 12 aa, Artificial Sequence
  Description of Artificial Sequence: Synthetic peptide
GASPGTSSTGSP

SEQ ID NO: 42 - protein, 12 aa, Artificial Sequence
  Description of Artificial Sequence: Synthetic peptide
GEPAGSPTSTSE

SEQ ID NO: 43 - protein, 12 aa, Artificial Sequence
  Description of Artificial Sequence: Synthetic peptide
GTGEPSSTPASE

SEQ ID NO: 44 - protein, 12 aa, Artificial Sequence
  Description of Artificial Sequence: Synthetic peptide
GSGPSTESAPTE

SEQ ID NO: 45 - protein, 12 aa, Artificial Sequence
  Description of Artificial Sequence: Synthetic peptide
GSETPSGPSETA

SEQ ID NO: 46 - protein, 12 aa, Artificial Sequence
  Description of Artificial Sequence: Synthetic peptide
GPSETSTSEPGA

SEQ ID NO: 47 - protein, 12 aa, Artificial Sequence
  Description of Artificial Sequence: Synthetic peptide
GSPSEPTEGTSA

SEQ ID NO: 48 - protein, 12 aa, Artificial Sequence
  Description of Artificial Sequence: Synthetic peptide
GSGASEPTSTEP

SEQ ID NO: 49 - protein, 12 aa, Artificial Sequence
  Description of Artificial Sequence: Synthetic peptide
GSEPATSGTEPS

SEQ ID NO: 50 - protein, 12 aa, Artificial Sequence
  Description of Artificial Sequence: Synthetic peptide
GTSEPSTSEPGA

SEQ ID NO: 51 - protein, 12 aa, Artificial Sequence
  Description of Artificial Sequence: Synthetic peptide
GTSTEPSEPGSA

SEQ ID NO: 52 - protein, 12 aa, Artificial Sequence
  Description of Artificial Sequence: Synthetic peptide
GSTAGSETSTEA

SEQ ID NO: 53 - protein, 12 aa, Artificial Sequence
  Description of Artificial Sequence: Synthetic peptide
GSETATSGSETA

SEQ ID NO: 54 - protein, 12 aa, Artificial Sequence
  Description of Artificial Sequence: Synthetic peptide
GTSESATSESGA

SEQ ID NO: 55 - protein, 12 aa, Artificial Sequence
  Description of Artificial Sequence: Synthetic peptide
GTSTEASEGSAS

SEQ ID NO: 56 - protein, 42 aa, Artificial Sequence
  Description of Artificial Sequence: Synthetic polypeptide
GAPGSPAGSPTSTEEGTSESATPESGPGSEPATSGSETPASS

SEQ ID NO: 57 - protein, 42 aa, Artificial Sequence
  Description of Artificial Sequence: Synthetic polypeptide
TEPSEGSAPGSPAGSPTSTEEGTSESATPESGPGSEPATSGS

SEQ ID NO: 58 - protein, 42 aa, Artificial Sequence
  Description of Artificial Sequence: Synthetic polypeptide
PAGSPTSTEEGTSTEPSEGSAPGTSESATPESGPGSEPATSG

SEQ ID NO: 59 - protein, 42 aa, Artificial Sequence
  Description of Artificial Sequence: Synthetic polypeptide
SEPATSGSETPGTSESATPESGPGTSTEPSEGSAPGSPAGSP

SEQ ID NO: 60 - protein, 42 aa, Artificial Sequence
  Description of Artificial Sequence: Synthetic polypeptide
GAPSPSASTGTGPGTPGSGTASSSPGSSTPSGATGSPGPSGP

SEQ ID NO: 61 - protein, 42 aa, Artificial Sequence
  Description of Artificial Sequence: Synthetic polypeptide
GPGTPGSGTASSSPGSSTPSGATGSPGSSPSASTGTGPGASP

SEQ ID NO: 62 - protein, 42 aa, Artificial Sequence
  Description of Artificial Sequence: Synthetic polypeptide
SPSASTGTGPGASPGTSSTGSPGTPGSGTASSSPGSSTPSGA

SEQ ID NO: 63 - protein, 42 aa, Artificial Sequence
  Description of Artificial Sequence: Synthetic polypeptide
SASTGTGPGASPGTSSTGSPGTPGSGTASSSPGSSTPSGATG

SEQ ID NO: 64 - protein, 48 aa, Artificial Sequence
  Description of Artificial Sequence: Synthetic polypeptide
MAEPAGSPTSTEEGTPGSGTASSSPGSSTPSGATGSPGASPGTSSTGS

SEQ ID NO: 65 - protein, 48 aa, Artificial Sequence
  Description of Artificial Sequence: Synthetic polypeptide
MAEPAGSPTSTEEGASPGTSSTGSPGSSTPSGATGSPGSSTPSGATGS

SEQ ID NO: 66 - protein, 144 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 67 - protein, 144 aa, Artificial Sequence
  Description of Artificial Sequence: Synthetic polypeptide
SPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPG

SEQ ID NO: 68 - protein, 144 aa, Artificial Sequence
  Description of Artificial Sequence: Synthetic polypeptide
TSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPG

SEQ ID NO: 69 - protein, 144 aa, Artificial Sequence; identical to SEQ ID NO: 68
  Description of Artificial Sequence: Synthetic polypeptide

SEQ ID NO: 70 - protein, 144 aa, Artificial Sequence
  Description of Artificial Sequence: Synthetic polypeptide
SPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPG

SEQ ID NO: 71 - protein, 144 aa, Artificial Sequence; identical to SEQ ID NO: 70
  Description of Artificial Sequence: Synthetic polypeptide

SEQ ID NO: 72 - protein, 144 aa, Artificial Sequence
  Description of Artificial Sequence: Synthetic polypeptide
TSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 73 - protein, 144 aa, Artificial Sequence; identical to SEQ ID NO: 72
  Description of Artificial Sequence: Synthetic polypeptide

SEQ ID NO: 74 - protein, 144 aa, Artificial Sequence
  Description of Artificial Sequence: Synthetic polypeptide
TSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEG

SEQ ID NO: 75 - protein, 144 aa, Artificial Sequence
  Description of Artificial Sequence: Synthetic polypeptide
TSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 76 - protein, 144 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 77 - protein, 144 aa, Artificial Sequence
  Description of Artificial Sequence: Synthetic polypeptide
SGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASP

SEQ ID NO: 78 - protein, 144 aa, Artificial Sequence
  Description of Artificial Sequence: Synthetic polypeptide
PGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSS

SEQ ID NO: 79 - protein, 144 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSP

SEQ ID NO: 80 - protein, 144 aa, Artificial Sequence
  Description of Artificial Sequence: Synthetic polypeptide
GTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSP

SEQ ID NO: 81 - protein, 144 aa, Artificial Sequence
  Description of Artificial Sequence: Synthetic polypeptide
GTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSP

SEQ ID NO: 82 - protein, 144 aa, Artificial Sequence
  Description of Artificial Sequence: Synthetic polypeptide
GSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 83 - protein, 144 aa, Artificial Sequence
  Description of Artificial Sequence: Synthetic polypeptide
GTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSP

SEQ ID NO: 84 - protein, 144 aa, Artificial Sequence
  Description of Artificial Sequence: Synthetic polypeptide
GTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSP

SEQ ID NO: 85 - protein, 288 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 86 - protein, 288 aa, Artificial Sequence
  Description of Artificial Sequence: Synthetic polypeptide
GSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 87 - protein, 288 aa, Artificial Sequence
  Description of Artificial Sequence: Synthetic polypeptide
PGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGS

SEQ ID NO: 88 - protein, 288 aa, Artificial Sequence
  Description of Artificial Sequence: Synthetic polypeptide
GSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSP

SEQ ID NO: 89 - protein, 504 aa, Artificial Sequence
  Description of Artificial Sequence: Synthetic polypeptide
  MOD_RES (63)..(63): Any amino acid
  MOD_RES (207)..(207): Any amino acid
GASPGTSSTGSPGSSPSASTGTGPGSSPSASTGTGPGTPGSGTASSSPGSSTPSGATGSPGSXPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSXPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 90 - protein, 540 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 91 - protein, 576 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 92 - protein, 576 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 93 - protein, 576 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 94 - protein, 576 aa, Artificial Sequence
  Description of Artificial Sequence: Synthetic polypeptide
PGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGS

SEQ ID NO: 95 - protein, 625 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 96 - protein, 836 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 97 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 98 - protein, 875 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 99 - protein, 864 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 100 - protein, 875 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 101 - protein, 1318 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 102 - protein, 864 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 103 - protein, 864 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 104 - protein, 948 aa, Artificial Sequence
  Description of Artificial Sequence: Synthetic polypeptide
GTSTEPSEGSAPGTSESATPESGPGSEPATSGSETPGTSESATPESGPGTSTEPSEGSAPGSPAGSPTSTEEGTSTEPSEGSAPGSEPATSGSETPGTSESATPESGPGTSESATPESGPGSEPATSGSETPGTSTEPSEGSAPGTSESATPESGPGTSTEPSEGSAPGTSTEPSEGSAPGSEPATSGSETPGTSTEPSEGSAPGSEPATSGSETPGSEPATSGSETPGTSTEPSEGSAPGSEPATSGSETPGSEPATSGSETPGTSTEPSEGSAPGSEPATSGSETPGSPAGSPTSTEEGTSESATPESGPGTSTEPSEGSAPGSEPATSGSETPGTSESATPESGPGSEPATSGSETPGSEPATSGSETPGTSESATPESGPGSPAGSPTSTEEGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSESATPESGPGSPAGSPTSTEEGSPAGSPTSTEEGTSESATPESGPGTSESATPESGPGTSTEPSEGSAPGSPAGSPTSTEEGTSESATPESGPGTSTEPSEGSAPGSEPATSGSETPGSPAGSPTSTEEGTSESATPESGPGTSTEPSEGSAPGSEPATSGSETPGSEPATSGSETPGSEPATSGSETPGSPAGSPTSTEEGTSESATPESGPGSEPATSGSETPGSEPATSGSETPGSPAGSPTSTEEGSPAGSPTSTEEGSPAGSPTSTEEGTSESATPESGPGSEPATSGSETPGTSTEPSEGSAPGTSTEPSEGSAPGSPAGSPTSTEEGSPAGSPTSTEEGSPAGSPTSTEEGTSTEPSEGSAPGTSESATPESGPGTSESATPESGPGTSTEPSEGSAPGTSTEPSEGSAPGTSTEPSEGSAPGTSESATPESGPGTSESATPESGP

SEQ ID NO: 105 - protein, 1024 aa, Artificial Sequence
  Description of Artificial Sequence: Synthetic polypeptide
GSEPATSGSETPGSEPATSGSETPGTSTEPSEGSAPGTSESATPESGPGSPAGSPTSTEEGTSTEPSEGSAPGTSESATPESGPGTSESATPESGPGSEPATSGSETPGSEPATSGSETPGTSESATPESGPGTSESATPESGPGSPAGSPTSTEEGTSTEPSEGSAPGSEPATSGSETPGTSTEPSEGSAPGSPAGSPTSTEEGSPAGSPTSTEEGSPAGSPTSTEEGTSTEPSEGSAPGTSESATPESGPGSEPATSGSETPGTSESATPESGPGTSESATPESGPGSPAGSPTSTEEGTSTEPSEGSAPGSEPATSGSETPGTSTEPSEGSAPGTSESATPESGPGSPAGSPTSTEEGTSTEPSEGSAPGTSTEPSEGSAPGSPAGSPTSTEEGTSTEPSEGSAPGTSESATPESGPGSPAGSPTSTEEGTSESATPESGPGSEPATSGSETPGTSTEPSEGSAPGSEPATSGSETPGTSESATPESGPGTSTEPSEGSAPGTSESATPESGPGTSTEPSEGSAPGTSTEPSEGSAPGSEPATSGSETPGSPAGSPTSTEEGTSESATPESGPGTSTEPSEGSAPGSPAGSPTSTEEGTSTEPSEGSAPGTSESATPESGPGTSTEPSEGSAPGSEPATSGSETPGSEPATSGSETPGTSESATPESGPGTSESATPESGPGTSESATPESGPGTSTEPSEGSAPGTSTEPSEGSAPGSPAGSPTSTEEGSPAGSPTSTEEGTSESATPESGPGSPAGSPTSTEEGSPAGSPTSTEEGTSESATPESGPGSEPATSGSETPGTSTEPSEGSAPGSEPATSGSETPGSPAGSPTSTEEGTSESATPESGPGTSESATPESGPGSEPATSGSETPGTSTEPSEGSAPGTSTEPSEGSAPGSPAGSPTSTEEGTSTEPSEGSAPGTSTEPSEGSAPGSEPATSGSETPGSPAGSPTSTEEGTSESATPESGPGTSTEPSEGSAPGSPAGSPTSTEEGTSESATPESGPGTSESATPESGPGTST

SEQ ID NO: 106 - protein, 1024 aa, Artificial Sequence
  Description of Artificial Sequence: Synthetic polypeptide
GSEPATSGSETPGSEPATSGSETPGTSTEPSEGSAPGSEPATSGSETPGTSESATPESGPGSEPATSGSETPGSPAGSPTSTEEGTSESATPESGPGSEPATSGSETPGTSTEPSEGSAPGTSESATPESGPGTSESATPESGPGTSTEPSEGSAPGTSTEPSEGSAPGSEPATSGSETPGSPAGSPTSTEEGTSTEPSEGSAPGSEPATSGSETPGSPAGSPTSTEEGTSTEPSEGSAPGTSESATPESGPGSPAGSPTSTEEGTSTEPSEGSAPGTSESATPESGPGSEPATSGSETPGTSESATPESGPGSEPATSGSETPGTSTEPSEGSAPGTSTEPSEGSAPGTSTEPSEGSAPGSPAGSPTSTEEGSPAGSPTSTEEGTSESATPESGPGTSTEPSEGSAPGTSTEPSEGSAPGSPAGSPTSTEEGSPAGSPTSTEEGSPAGSPTSTEEGTSESATPESGPGSEPATSGSETPGTSESATPESGPGSPAGSPTSTEEGTSTEPSEGSAPGTSESATPESGPGSEPATSGSETPGSPAGSPTSTEEGTSTEPSEGSAPGTSESATPESGPGTSESATPESGPGSPAGSPTSTEEGTSTEPSEGSAPGSPAGSPTSTEEGSPAGSPTSTEEGTSESATPESGPGSEPATSGSETPGTSTEPSEGSAPGSEPATSGSETPGTSESATPESGPGTSTEPSEGSAPGTSESATPESGPGTSESATPESGPGTSTEPSEGSAPGTSTEPSEGSAPGSEPATSGSETPGTSESATPESGPGTSTEPSEGSAPGSEPATSGSETPGSPAGSPTSTEEGTSESATPESGPGSPAGSPTSTEEGTSTEPSEGSAPGSEPATSGSETPGSEPATSGSETPGSEPATSGSETPGTSESATPESGPGTSESATPESGPGTSTEPSEGSAPGTSTEPSEGSAPGSEPATSGSETPGTSTEPSEGSAPGTSESATPESGPGSPAGSPTSTEEGSPAGSPTSTEEGTSTEPSEGSAPGSPAGSPTSTEEGSPA

SEQ ID NO: 107 - protein, 1024 aa, Artificial Sequence
  Description of Artificial Sequence: Synthetic polypeptide
GSPAGSPTSTEEGTSTEPSEGSAPGSPAGSPTSTEEGTSESATPESGPGSEPATSGSETPGTSTEPSEGSAPGTSTEPSEGSAPGTSESATPESGPGTSTEPSEGSAPGTSTEPSEGSAPGSEPATSGSETPGSPAGSPTSTEEGTSESATPESGPGSPAGSPTSTEEGTSTEPSEGSAPGSPAGSPTSTEEGTSTEPSEGSAPGSPAGSPTSTEEGTSTEPSEGSAPGSPAGSPTSTEEGSPAGSPTSTEEGTSTEPSEGSAPGSEPATSGSETPGSPAGSPTSTEEGTSESATPESGPGSEPATSGSETPGSEPATSGSETPGTSESATPESGPGSPAGSPTSTEEGTSESATPESGPGSEPATSGSETPGSEPATSGSETPGTSESATPESGPGTSESATPESGPGTSTEPSEGSAPGTSTEPSEGSAPGTSESATPESGPGSPAGSPTSTEEGTSTEPSEGSAPGSEPATSGSETPGSPAGSPTSTEEGTSTEPSEGSAPGTSTEPSEGSAPGSPAGSPTSTEEGSPAGSPTSTEEGSPAGSPTSTEEGTSESATPESGPGSEPATSGSETPGTSESATPESGPGTSESATPESGPGTSTEPSEGSAPGTSESATPESGPGSPAGSPTSTEEGTSESATPESGPGTSESATPESGPGTSTEPSEGSAPGSEPATSGSETPGTSTEPSEGSAPGSPAGSPTSTEEGTSESATPESGPGTSTEPSEGSAPGTSTEPSEGSAPGSEPATSGSETPGSEPATSGSETPGTSESATPESGPGSEPATSGSETPGSPAGSPTSTEEGTSESATPESGPGSEPATSGSETPGTSTEPSEGSAPGTSESATPESGPGTSESATPESGPGTSTEPSEGSAPGSEPATSGSETPGTSTEPSEGSAPGSPAGSPTSTEEGSPAGSPTSTEEGTSESATPESGPGSEPATSGSETPGSPAGSPTSTEEGSPAGSPTSTEEGTSESATPESGPGSEPATSGSETPGTSTEPSEGSAPGTSTEPSEGSAPGSEP

SEQ ID NO: 108 - protein, 1024 aa, Artificial Sequence
  Description of Artificial Sequence: Synthetic polypeptide
GSPAGSPTSTEEGTSTEPSEGSAPGTSESATPESGPGTSESATPESGPGSEPATSGSETPGTSTEPSEGSAPGTSESATPESGPGSPAGSPTSTEEGTSTEPSEGSAPGTSESATPESGPGSPAGSPTSTEEGTSTEPSEGSAPGTSESATPESGPGTSTEPSEGSAPGSEPATSGSETPGSEPATSGSETPGSEPATSGSETPGTSESATPESGPGSPAGSPTSTEEGTSESATPESGPGSEPATSGSETPGTSESATPESGPGTSESATPESGPGSPAGSPTSTEEGTSTEPSEGSAPGTSESATPESGPGTSTEPSEGSAPGTSTEPSEGSAPGTSTEPSEGSAPGSEPATSGSETPGTSTEPSEGSAPGTSESATPESGPGTSESATPESGPGTSTEPSEGSAPGTSESATPESGPGTSESATPESGPGSEPATSGSETPGTSTEPSEGSAPGTSESATPESGPGSPAGSPTSTEEGSPAGSPTSTEEGTSTEPSEGSAPGSEPATSGSETPGSEPATSGSETPGTSTEPSEGSAPGSEPATSGSETPGSPAGSPTSTEEGTSESATPESGPGSEPATSGSETPGSEPATSGSETPGTSESATPESGPGTSESATPESGPGTSTEPSEGSAPGSPAGSPTSTEEGTSESATPESGPGTSTEPSEGSAPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSESATPESGPGTSTEPSEGSAPGSEPATSGSETPGSEPATSGSETPGTSTEPSEGSAPGTSESATPESGPGSPAGSPTSTEEGTSTEPSEGSAPGTSTEPSEGSAPGSPAGSPTSTEEGSPAGSPTSTEEGTSTEPSEGSAPGSEPATSGSETPGSPAGSPTSTEEGTSESATPESGPGSEPATSGSETPGSEPATSGSETPGTSESATPESGPGTSESATPESGPGTSTEPSEGSAPGTST

SEQ ID NO: 109 - protein, 1024 aa, Artificial Sequence
  Description of Artificial Sequence: Synthetic polypeptide
GSEPATSGSETPGSPAGSPTSTEEGTSTEPSEGSAPGSEPATSGSETPGTSESATPESGPGTSTEPSEGSAPGTSESATPESGPGSPAGSPTSTEEGTSTEPSEGSAPGTSTEPSEGSAPGSPAGSPTSTEEGTSTEPSEGSAPGTSESATPESGPGSEPATSGSETPGTSESATPESGPGSEPATSGSETPGTSTEPSEGSAPGTSTEPSEGSAPGSEPATSGSETPGTSTEPSEGSAPGTSTEPSEGSAPGSPAGSPTSTEEGTSTEPSEGSAPGTSESATPESGPGTSESATPESGPGTSTEPSEGSAPGTSTEPSEGSAPGSPAGSPTSTEEGSPAGSPTSTEEGTSTEPSEGSAPGSEPATSGSETPGSPAGSPTSTEEGTSTEPSEGSAPGSPAGSPTSTEEGSPAGSPTSTEEGTSESATPESGPGSEPATSGSETPGSEPATSGSETPGTSTEPSEGSAPGSPAGSPTSTEEGSPAGSPTSTEEGTSESATPESGPGSEPATSGSETPGSEPATSGSETPGTSESATPESGPGSEPATSGSETPGSEPATSGSETPGTSESATPESGPGTSESATPESGPGTSESATPESGPGTSESATPESGPGSPAGSPTSTEEGTSTEPSEGSAPGTSESATPESGPGTSTEPSEGSAPGTSTEPSEGSAPGTSESATPESGPGTSTEPSEGSAPGTSESATPESGPGSPAGSPTSTEEGTSTEPSEGSAPGSEPATSGSETPGTSTEPSEGSAPGSEPATSGSETPGTSTEPSEGSAPGTSTEPSEGSAPGSPAGSPTSTEEGTSESATPESGPGTSTEPSEGSAPGSEPATSGSETPGTSESATPESGPGTSESATPESGPGTSESATPESGPGTSTEPSEGSAPGSEPATSGSETPGSPAGSPTSTEEGTSESATPESGPGTSTEPSEGSAPGTSTEPSEGSAPGSPAGSPTSTEEGTSESATPESGPGTSTEPSEGSAPGTSTEPSEGSAPGSPAGSPTSTEEGTSESATPESGPGSPA

SEQ ID NO: 110 - protein, 1024 aa, Artificial Sequence
  Description of Artificial Sequence: Synthetic polypeptide
GTSTEPSEGSAPGTSTEPSEGSAPGTSTEPSEGSAPGTSTEPSEGSAPGSPAGSPTSTEEGSPAGSPTSTEEGTSESATPESGPGSEPATSGSETPGTSTEPSEGSAPGTSESATPESGPGTSTEPSEGSAPGTSESATPESGPGTSESATPESGPGSPAGSPTSTEEGTSTEPSEGSAPGSEPATSGSETPGTSTEPSEGSAPGSPAGSPTSTEEGTSTEPSEGSAPGSPAGSPTSTEEGSPAGSPTSTEEGSPAGSPTSTEEGTSESATPESGPGSEPATSGSETPGTSESATPESGPGTSESATPESGPGSPAGSPTSTEEGTSTEPSEGSAPGSEPATSGSETPGTSTEPSEGSAPGSPAGSPTSTEEGSPAGSPTSTEEGTSTEPSEGSAPGSEPATSGSETPGSPAGSPTSTEEGTSESATPESGPGSEPATSGSETPGSPAGSPTSTEEGTSESATPESGPGTSESATPESGPGTSTEPSEGSAPGSEPATSGSETPGSEPATSGSETPGTSESATPESGPGSEPATSGSETPGTSTEPSEGSAPGSPAGSPTSTEEGTSTEPSEGSAPGSEPATSGSETPGSEPATSGSETPGSPAGSPTSTEEGTSESATPESGPGTSTEPSEGSAPGSPAGSPTSTEEGSPAGSPTSTEEGTSESATPESGPGSPAGSPTSTEEGTSTEPSEGSAPGSEPATSGSETPGSEPATSGSETPGSEPATSGSETPGTSESATPESGPGTSESATPESGPGTSTEPSEGSAPGTSTEPSEGSAPGSEPATSGSETPGTSTEPSEGSAPGTSESATPESGPGSPAGSPTSTEEGSPAGSPTSTEEGTSTEPSEGSAPGTSESATPESGPGSPAGSPTSTEEGTSTEPSEGSAPGSEPATSGSETPGTSESATPESGPGSEPATSGSETPGTSESATPESGPGSEPATSGSETPGSEPATSGSETPGTSTEPSEGSAPGTSESATPESGPGTSTEPSEGSAPGTSTEPSEGSAPGTSESATPESGPGSPA

SEQ ID NO: 111 - protein, 1024 aa, Artificial Sequence
  Description of Artificial Sequence: Synthetic polypeptide
GSEPATSGSETPGTSTEPSEGSAPGSEPATSGSETPGTSTEPSEGSAPGTSESATPESGPGTSESATPESGPGSEPATSGSETPGTSTEPSEGSAPGTSTEPSEGSAPGTSESATPESGPGTSTEPSEGSAPGTSTEPSEGSAPGSEPATSGSETPGSPAGSPTSTEEGTSESATPESGPGTSESATPESGPGTSTEPSEGSAPGTSESATPESGPGSEPATSGSETPGTSESATPESGPGTSESATPESGPGTSTEPSEGSAPGTSTEPSEGSAPGSEPATSGSETPGSPAGSPTSTEEGTSESATPESGPGSEPATSGSETPGSEPATSGSETPGTSESATPESGPGTSESATPESGPGSPAGSPTSTEEGTSTEPSEGSAPGTSESATPESGPGTSTEPSEGSAPGTSTEPSEGSAPGTSESATPESGPGTSTEPSEGSAPGSPAGSPTSTEEGSPAGSPTSTEEGTSESATPESGPGSEPATSGSETPGSEPATSGSETPGTSTEPSEGSAPGTSESATPESGPGSPAGSPTSTEEGSPAGSPTSTEEGTSTEPSEGSAPGSPAGSPTSTEEGSPAGSPTSTEEGTSESATPESGPGSEPATSGSETPGTSTEPSEGSAPGTSTEPSEGSAPGSEPATSGSETPGSPAGSPTSTEEGTSESATPESGPGSPAGSPTSTEEGTSTEPSEGSAPGTSESATPESGPGSEPATSGSETPGTSESATPESGPGTSESATPESGPGSPAGSPTSTEEGTSTEPSEGSAPGSEPATSGSETPGSPAGSPTSTEEGTSTEPSEGSAPGSEPATSGSETPGSEPATSGSETPGTSESATPESGPGTSESATPESGPGTSTEPSEGSAPGTSESATPESGPGSEPATSGSETPGTSESATPESGPGTSESATPESGPGTSTEPSEGSAPGTSESATPESGPGSEPATSGSETPGTSTEPSEGSAPGSPAGSPTSTEEGTSESATPESGPGTSTEPSEGSAPGTSTEPSEGSAPGSPAGSPTSTEEGTST

SEQ ID NO: 112 - protein, 1024 aa, Artificial Sequence
  Description of Artificial Sequence: Synthetic polypeptide
GTSESATPESGPGTSTEPSEGSAPGTSESATPESGPGTSTEPSEGSAPGSEPATSGSETPGSPAGSPTSTEEGTSESATPESGPGSEPATSGSETPGSEPATSGSETPGTSESATPESGPGTSESATPESGPGTSTEPSEGSAPGSEPATSGSETPGSEPATSGSETPGTSESATPESGPGTSESATPESGPGSEPATSGSETPGTSESATPESGPGSPAGSPTSTEEGSPAGSPTSTEEGTSTEPSEGSAPGSEPATSGSETPGSPAGSPTSTEEGTSESATPESGPGSPAGSPTSTEEGTSTEPSEGSAPGSEPATSGSETPGSPAGSPTSTEEGTSESATPESGPGSPAGSPTSTEEGSPAGSPTSTEEGTSTEPSEGSAPGSEPATSGSETPGSPAGSPTSTEEGTSESATPESGPGTSTEPSEGSAPGSPAGSPTSTEEGTSESATPESGPGSEPATSGSETPGTSTEPSEGSAPGSPAGSPTSTEEGTSTEPSEGSAPGTSESATPESGPGTSESATPESGPGTSTEPSEGSAPGTSTEPSEGSAPGSEPATSGSETPGTSESATPESGPGTSESATPESGPGTSTEPSEGSAPGTSTEPSEGSAPGSPAGSPTSTEEGSPAGSPTSTEEGTSTEPSEGSAPGSEPATSGSETPGSEPATSGSETPGTSESATPESGPGSPAGSPTSTEEGTSESATPESGPGTSTEPSEGSAPGTSTEPSEGSAPGSPAGSPTSTEEGSPAGSPTSTEEGTSESATPESGPGSPAGSPTSTEEGTSTEPSEGSAPGSEPATSGSETPGSPAGSPTSTEEGSPAGSPTSTEEGTSTEPSEGSAPGTSESATPESGPGTSESATPESGPGSPAGSPTSTEEGTSTEPSEGSAPGSPAGSPTSTEEGTSTEPSEGSAPGSPAGSPTSTEEGTSTEPSEGSAPGTSTEPSEGSAPGSEPATSGSETPGSPAGSPTSTEEGTSESATPESGPGSEPATSGSETPGSPAGSPTSTEEGTSESATPESGPGTSE

SEQ ID NO: 113 - protein, 1024 aa, Artificial Sequence
  Description of Artificial Sequence: Synthetic polypeptide
GTSESATPESGPGSPAGSPTSTEEGSPAGSPTSTEEGTSESATPESGPGSEPATSGSETPGTSTEPSEGSAPGTSTEPSEGSAPGTSTEPSEGSAPGSPAGSPTSTEEGTSTEPSEGSAPGTSESATPESGPGTSESATPESGPGSPAGSPTSTEEGSPAGSPTSTEEGSPAGSPTSTEEGTSESATPESGPGSEPATSGSETPGTSESATPESGPGTSTEPSEGSAPGTSESATPESGPGTSTEPSEGSAPGTSTEPSEGSAPGTSESATPESGPGSPAGSPTSTEEGTSESATPESGPGTSTEPSEGSAPGSPAGSPTSTEEGTSESATPESGPGSEPATSGSETPGTSTEPSEGSAPGSEPATSGSETPGSEPATSGSETPGTSESATPESGPGTSESATPESGPGTSTEPSEGSAPGTSESATPESGPGSPAGSPTSTEEGTSTEPSEGSAPGSEPATSGSETPGTSESATPESGPGSEPATSGSETPGTSTEPSEGSAPGTSESATPESGPGSPAGSPTSTEEGSPAGSPTSTEEGSPAGSPTSTEEGTSESATPESGPGSEPATSGSETPGTSESATPESGPGTSESATPESGPGSEPATSGSETPGTSTEPSEGSAPGTSTEPSEGSAPGTSTEPSEGSAPGTSESATPESGPGSEPATSGSETPGTSESATPESGPGSEPATSGSETPGTSTEPSEGSAPGSEPATSGSETPGSPAGSPTSTEEGTSESATPESGPGTSESATPESGPGTSESATPESGPGSPAGSPTSTEEGTSTEPSEGSAPGTSESATPESGPGTSESATPESGPGTSTEPSEGSAPGTSTEPSEGSAPGSPAGSPTSTEEGTSESATPESGPGSEPATSGSETPGTSESATPESGPGTSESATPESGPGTSTEPSEGSAPGSEPATSGSETPGTSESATPESGPGSPAGSPTSTEEGTSTEPSEGSAPGSEPATSGSETPGSPAGSPTSTEEGTSESATPESGPGSPAGSPTSTEEGTSTEPSEGSAPGSEP

SEQ ID NO: 114 - protein, 1024 aa, Artificial Sequence
  Description of Artificial Sequence: Synthetic polypeptide
GSEPATSGSETPGTSTEPSEGSAPGTSESATPESGPGSEPATSGSETPGTSTEPSEGSAPGSPAGSPTSTEEGTSESATPESGPGSPAGSPTSTEEGTSTEPSEGSAPGSEPATSGSETPGTSTEPSEGSAPGTSESATPESGPGSEPATSGSETPGSEPATSGSETPGTSESATPESGPGTSTEPSEGSAPGTSESATPESGPGTSESATPESGPGSPAGSPTSTEEGSPAGSPTSTEEGTSESATPESGPGTSESATPESGPGTSTEPSEGSAPGTSTEPSEGSAPGSPAGSPTSTEEGTSTEPSEGSAPGSEPATSGSETPGSEPATSGSETPGSEPATSGSETPGSEPATSGSETPGTSESATPESGPGTSESATPESGPGTSESATPESGPGTSTEPSEGSAPGTSESATPESGPGTSESATPESGPGTSTEPSEGSAPGSPAGSPTSTEEGTSTEPSEGSAPGSEPATSGSETPGSPAGSPTSTEEGTSESATPESGPGTSTEPSEGSAPGSEPATSGSETPGTSESATPESGPGTSESATPESGPGTSTEPSEGSAPGSEPATSGSETPGSPAGSPTSTEEGTSESATPESGPGTSESATPESGPGTSTEPSEGSAPGSEPATSGSETPGSPAGSPTSTEEGTSESATPESGPGSEPATSGSETPGTSTEPSEGSAPGSEPATSGSETPGSPAGSPTSTEEGTSESATPESGPGTSTEPSEGSAPGSEPATSGSETPGTSESATPESGPGTSESATPESGPGSPAGSPTSTEEGTSTEPSEGSAPGSPAGSPTSTEEGSPAGSPTSTEEGSPAGSPTSTEEGTSESATPESGPGSEPATSGSETPGTSTEPSEGSAPGTSTEPSEGSAPGTSESATPESGPGTSTEPSEGSAPGTSESATPESGPGSEPATSGSETPGTSTEPSEGSAPGTSESATPESGPGSPAGSPTSTEEGSPAGSPTSTEEGSPAGSPTSTEEGTSESATPESGPGSPAGSPTSTEEGTSESATPESGPGSEP

SEQ ID NO: 115 - protein, 1024 aa, Artificial Sequence
  Description of Artificial Sequence: Synthetic polypeptide
GTSTEPSEGSAPGSEPATSGSETPGTSTEPSEGSAPGTSTEPSEGSAPGSEPATSGSETPGSPAGSPTSTEEGSPAGSPTSTEEGTSESATPESGPGSEPATSGSETPGTSTEPSEGSAPGTSTEPSEGSAPGSPAGSPTSTEEGTSESATPESGPGTSESATPESGPGSPAGSPTSTEEGTSTEPSEGSAPGTSESATPESGPGTSTEPSEGSAPGSEPATSGSETPGTSESATPESGPGSEPATSGSETPGTSTEPSEGSAPGTSTEPSEGSAPGSPAGSPTSTEEGSPAGSPTSTEEGTSESATPESGPGSPAGSPTSTEEGTSTEPSEGSAPGSEPATSGSETPGSEPATSGSETPGSPAGSPTSTEEGTSESATPESGPGTSTEPSEGSAPGSEPATSGSETPGTSESATPESGPGSEPATSGSETPGSPAGSPTSTEEGTSESATPESGPGTSESATPESGPGSEPATSGSETPGTSESATPESGPGTSESATPESGPGTSESATPESGPGTSTEPSEGSAPGTSESATPESGPGSEPATSGSETPGTSTEPSEGSAPGSPAGSPTSTEEGTSTEPSEGSAPGSEPATSGSETPGSPAGSPTSTEEGTSESATPESGPGTSESATPESGPGTSTEPSEGSAPGTSESATPESGPGTSTEPSEGSAPGTSESATPESGPGSEPATSGSETPGTSTEPSEGSAPGTSTEPSEGSAPGSPAGSPTSTEEGSPAGSPTSTEEGTSESATPESGPGTSTEPSEGSAPGTSESATPESGPGSPAGSPTSTEEGSPAGSPTSTEEGSPAGSPTSTEEGTSTEPSEGSAPGSPAGSPTSTEEGSPAGSPTSTEEGTSESATPESGPGSEPATSGSETPGSEPATSGSETPGTSESATPESGPGSEPATSGSETPGTSESATPESGPGTSTEPSEGSAPGTSTEPSEGSAPGSPAGSPTSTEEGSPAGSPTSTEEGTSESATPESGPGSPAGSPTSTEEGTSTEPSEGSAPGTSESATPESGPGTSE

SEQ ID NO: 116 - protein, 948 aa, Artificial Sequence
  Description of Artificial Sequence: Synthetic polypeptide
GSSTPSGATGSPGTPGSGTASSSPGASPGTSSTGSPGSSPSASTGTGPGTPGSGTASSSPGTPGSGTASSSPGTPGSGTASSSPGSSPSASTGTGPGTPGSGTASSSPGSSPSASTGTGPGSSTPSGATGSPGSSTPSGATGSPGSSPSASTGTGPGSSTPSGATGSPGASPGTSSTGSPGASPGTSSTGSPGSSPSASTGTGPGSSPSASTGTGPGASPGTSSTGSPGSSPSASTGTGPGASPGTSSTGSPGSSPSASTGTGPGASPGTSSTGSPGTPGSGTASSSPGTPGSGTASSSPGSSTPSGATGSPGSSTPSGATGSPGSSTPSGATGSPGASPGTSSTGSPGSSPSASTGTGPGASPGTSSTGSPGASPGTSSTGSPGSSTPSGATGSPGSSPSASTGTGPGSSPSASTGTGPGTPGSGTASSSPGASPGTSSTGSPGTPGSGTASSSPGSSTPSGATGSPGSSTPSGATGSPGSSPSASTGTGPGSSPSASTGTGPGSSTPSGATGSPGASPGTSSTGSPGTPGSGTASSSPGSSPSASTGTGPGSSTPSGATGSPGASPGTSSTGSPGSSTPSGATGSPGTPGSGTASSSPGSSPSASTGTGPGSSTPSGATGSPGASPGTSSTGSPGASPGTSSTGSPGTPGSGTASSSPGTPGSGTASSSPGSSPSASTGTGPGASPGTSSTGSPGASPGTSSTGSPGTPGSGTASSSPGTPGSGTASSSPGSSTPSGATGSPGSSPSASTGTGPGSSTPSGATGSPGSSPSASTGTGPGSSPSASTGTGPGTPGSGTASSSPGSSTPSGATGSPGASPGTSSTGSPGTPGSGTASSSPGTPGSGTASSSPGSSTPSGATGSPGTPGSGTASSSPGASPGTSSTGSPGSSTPSGATGSPGSSTPSGATGSPGTPGSGTASSSPGSSTPSGATGSPGSSTPSGATGSP

SEQ ID NO: 117 - protein, 1024 aa, Artificial Sequence
  Description of Artificial Sequence: Synthetic polypeptide
GTPGSGTASSSPGTPGSGTASSSPGSSPSASTGTGPGTPGSGTASSSPGASPGTSSTGSPGTPGSGTASSSPGSSPSASTGTGPGSSTPSGATGSPGASPGTSSTGSPGASPGTSSTGSPGSSPSASTGTGPGSSTPSGATGSPGSSPSASTGTGPGSSPSASTGTGPGTPGSGTASSSPGTPGSGTASSSPGASPGTSSTGSPGSSTPSGATGSPGSSPSASTGTGPGTPGSGTASSSPGASPGTSSTGSPGTPGSGTASSSPGSSPSASTGTGPGSSPSASTGTGPGASPGTSSTGSPGASPGTSSTGSPGSSTPSGATGSPGSSTPSGATGSPGTPGSGTASSSPGSSPSASTGTGPGSSTPSGATGSPGASPGTSSTGSPGSSTPSGATGSPGSSTPSGATGSPGSSPSASTGTGPGASPGTSSTGSPGTPGSGTASSSPGASPGTSSTGSPGSSPSASTGTGPGTPGSGTASSSPGASPGTSSTGSPGASPGTSSTGSPGSSTPSGATGSPGTPGSGTASSSPGSSTPSGATGSPGASPGTSSTGSPGTPGSGTASSSPGTPGSGTASSSPGSSTPSGATGSPGSSTPSGATGSPGTPGSGTASSSPGSSTPSGATGSPGSSTPSGATGSPGASPGTSSTGSPGSSPSASTGTGPGSSPSASTGTGPGASPGTSSTGSPGASPGTSSTGSPGTPGSGTASSSPGSSPSASTGTGPGTPGSGTASSSPGSSTPSGATGSPGSSTPSGATGSPGASPGTSSTGSPGSSPSASTGTGPGASPGTSSTGSPGSSPSASTGTGPGSSPSASTGTGPGASPGTSSTGSPGASPGTSSTGSPGSSTPSGATGSPGASPGTSSTGSPGASPGTSSTGSPGTPGSGTASSSPGTPGSGTASSSPGTPGSGTASSSPGSSTPSGATGSPGSSTPSGATGSPGSSPSASTGTGPGSSPSASTGTGPGTPGSGTASSSPGSSPSASTGTGPGASPGTSSTGSPGSSTPSGATGSPGTPGSGTASSSPGSST

SEQ ID NO: 118 - protein, 1024 aa, Artificial Sequence
  Description of Artificial Sequence: Synthetic polypeptide
GASPGTSSTGSPGSSPSASTGTGPGSSTPSGATGSPGASPGTSSTGSPGASPGTSSTGSPGSSTPSGATGSPGTPGSGTASSSPGASPGTSSTGSPGTPGSGTASSSPGTPGSGTASSSPGSSTPSGATGSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGASPGTSSTGSPGSSTPSGATGSPGTPGSGTASSSPGSSPSASTGTGPGSSTPSGATGSPGSSPSASTGTGPGSSTPSGATGSPGASPGTSSTGSPGSSPSASTGTGPGTPGSGTASSSPGASPGTSSTGSPGSSTPSGATGSPGASPGTSSTGSPGSSPSASTGTGPGTPGSGTASSSPGTPGSGTASSSPGASPGTSSTGSPGTPGSGTASSSPGTPGSGTASSSPGSSPSASTGTGPGASPGTSSTGSPGSSTPSGATGSPGASPGTSSTGSPGSSPSASTGTGPGTPGSGTASSSPGSSPSASTGTGPGSSPSASTGTGPGASPGTSSTGSPGASPGTSSTGSPGTPGSGTASSSPGASPGTSSTGSPGASPGTSSTGSPGTPGSGTASSSPGTPGSGTASSSPGSSTPSGATGSPGSSTPSGATGSPGTPGSGTASSSPGSSPSASTGTGPGTPGSGTASSSPGSSTPSGATGSPGSSTPSGATGSPGASPGTSSTGSPGTPGSGTASSSPGASPGTSSTGSPGSSTPSGATGSPGSSTPSGATGSPGTPGSGTASSSPGSSTPSGATGSPGSSTPSGATGSPGASPGTSSTGSPGSSPSASTGTGPGSSTPSGATGSPGSSTPSGATGSPGSSPSASTGTGPGSSPSASTGTGPGSSTPSGATGSPGASPGTSSTGSPGSSPSASTGTGPGTPGSGTASSSPGASPGTSSTGSPGSSPSASTGTGPGASPGTSSTGSPGSSTPSGATGSPGSSPSASTGTGPGSSPSASTGTGPGASPGTSSTGSPGSST

SEQ ID NO: 119 - protein, 1024 aa, Artificial Sequence
  Description of Artificial Sequence: Synthetic polypeptide
GSSPSASTGTGPGTPGSGTASSSPGSSPSASTGTGPGSSPSASTGTGPGTPGSGTASSSPGASPGTSSTGSPGSSTPSGATGSPGTPGSGTASSSPGASPGTSSTGSPGTPGSGTASSSPGTPGSGTASSSPGSSPSASTGTGPGSSPSASTGTGPGSSTPSGATGSPGASPGTSSTGSPGSSPSASTGTGPGTPGSGTASSSPGTPGSGTASSSPGSSTPSGATGSPGASPGTSSTGSPGSSPSASTGTGPGTPGSGTASSSPGTPGSGTASSSPGASPGTSSTGSPGSSTPSGATGSPGSSTPSGATGSPGSSPSASTGTGPGSSPSASTGTGPGASPGTSSTGSPGSSPSASTGTGPGSSTPSGATGSPGASPGTSSTGSPGASPGTSSTGSPGSSTPSGATGSPGSSPSASTGTGPGASPGTSSTGSPGASPGTSSTGSPGTPGSGTASSSPGSSTPSGATGSPGASPGTSSTGSPGSSTPSGATGSPGTPGSGTASSSPGSSPSASTGTGPGSSTPSGATGSPGTPGSGTASSSPGSSTPSGATGSPGSSTPSGATGSPGASPGTSSTGSPGSSPSASTGTGPGSSPSASTGTGPGASPGTSSTGSPGSSPSASTGTGPGTPGSGTASSSPGTPGSGTASSSPGASPGTSSTGSPGTPGSGTASSSPGASPGTSSTGSPGTPGSGTASSSPGASPGTSSTGSPGSSTPSGATGSPGASPGTSSTGSPGSSPSASTGTGPGTPGSGTASSSPGTPGSGTASSSPGSSPSASTGTGPGTPGSGTASSSPGASPGTSSTGSPGSSTPSGATGSPGTPGSGTASSSPGASPGTSSTGSPGTPGSGTASSSPGTPGSGTASSSPGSSTPSGATGSPGTPGSGTASSSPGSSPSASTGTGPGSSTPSGATGSPGTPGSGTASSSPGSSTPSGATGSPGSSTPSGATGSPGSSPSASTGTGPGASPGTSSTGSPGTPGSGTASSSPGSSPSASTGTGPGSSPSASTGTGPGASPGTSSTGSPGASP

SEQ ID NO: 120 - protein, 1024 aa, Artificial Sequence
  Description of Artificial Sequence: Synthetic polypeptide
GSSTPSGATGSPGSSPSASTGTGPGTPGSGTASSSPGSSPSASTGTGPGASPGTSSTGSPGSSPSASTGTGPGTPGSGTASSSPGASPGTSSTGSPGSSTPSGATGSPGSSPSASTGTGPGSSTPSGATGSPGASPGTSSTGSPGTPGSGTASSSPGASPGTSSTGSPGSSTPSGATGSPGSSTPSGATGSPGSSPSASTGTGPGTPGSGTASSSPGSSTPSGATGSPGSSTPSGATGSPGSSPSASTGTGPGTPGSGTASSSPGASPGTSSTGSPGTPGSGTASSSPGASPGTSSTGSPGASPGTSSTGSPGTPGSGTASSSPGTPGSGTASSSPGSSTPSGATGSPGSSTPSGATGSPGSSTPSGATGSPGASPGTSSTGSPGSSPSASTGTGPGSSTPSGATGSPGSSPSASTGTGPGSSTPSGATGSPGTPGSGTASSSPGSSPSASTGTGPGSSTPSGATGSPGASPGTSSTGSPGASPGTSSTGSPGSSPSASTGTGPGASPGTSSTGSPGSSTPSGATGSPGASPGTSSTGSPGTPGSGTASSSPGTPGSGTASSSPGSSPSASTGTGPGTPGSGTASSSPGSSTPSGATGSPGSSPSASTGTGPGSSTPSGATGSPGTPGSGTASSSPGTPGSGTASSSPGSSPSASTGTGPGSSTPSGATGSPGSSTPSGATGSPGSSPSASTGTGPGSSPSASTGTGPGASPGTSSTGSPGASPGTSSTGSPGSSTPSGATGSPGASPGTSSTGSPGSSPSASTGTGPGTPGSGTASSSPGASPGTSSTGSPGASPGTSSTGSPGTPGSGTASSSPGTPGSGTASSSPGSSPSASTGTGPGTPGSGTASSSPGASPGTSSTGSPGSSTPSGATGSPGTPGSGTASSSPGTPGSGTASSSPGSSTPSGATGSPGSSTPSGATGSPGTPGSGTASSSPGSSPSASTGTGPGSSPSASTGTGPGASPGTSSTGSPGSSPSASTGTGPGSSPSASTGTGPGASPGTSSTGSPGASPGTSSTGSPGTPG

SEQ ID NO: 121 - protein, 1024 aa, Artificial Sequence
  Description of Artificial Sequence: Synthetic polypeptide
GTPGSGTASSSPGSSTPSGATGSPGASPGTSSTGSPGSSTPSGATGSPGTPGSGTASSSPGTPGSGTASSSPGSSTPSGATGSPGSSTPSGATGSPGASPGTSSTGSPGSSPSASTGTGPGSSTPSGATGSPGASPGTSSTGSPGSSPSASTGTGPGTPGSGTASSSPGASPGTSSTGSPGASPGTSSTGSPGTPGSGTASSSPGTPGSGTASSSPGASPGTSSTGSPGASPGTSSTGSPGTPGSGTASSSPGTPGSGTASSSPGSSPSASTGTGPGSSPSASTGTGPGASPGTSSTGSPGSSPSASTGTGPGSSPSASTGTGPGASPGTSSTGSPGASPGTSSTGSPGTPGSGTASSSPGTPGSGTASSSPGSSPSASTGTGPGASPGTSSTGSPGSSTPSGATGSPGASPGTSSTGSPGSSPSASTGTGPGSSTPSGATGSPGSSPSASTGTGPGSSPSASTGTGPGASPGTSSTGSPGSSPSASTGTGPGSSPSASTGTGPGASPGTSSTGSPGASPGTSSTGSPGSSPSASTGTGPGTPGSGTASSSPGASPGTSSTGSPGSSTPSGATGSPGTPGSGTASSSPGTPGSGTASSSPGSSPSASTGTGPGSSTPSGATGSPGASPGTSSTGSPGASPGTSSTGSPGSSTPSGATGSPGSSPSASTGTGPGASPGTSSTGSPGSSTPSGATGSPGTPGSGTASSSPGASPGTSSTGSPGTPGSGTASSSPGASPGTSSTGSPGSSTPSGATGSPGSSTPSGATGSPGASPGTSSTGSPGSSPSASTGTGPGTPGSGTASSSPGTPGSGTASSSPGSSTPSGATGSPGTPGSGTASSSPGASPGTSSTGSPGSSTPSGATGSPGTPGSGTASSSPGSSPSASTGTGPGSSTPSGATGSPGSSTPSGATGSPGSSPSASTGTGPGSSTPSGATGSPGTPGSGTASSSPGSSPSASTGTGPGTPGSGTASSSPGSSTPSGATGSPGSSPSASTGTGPGSSPSASTGTGPGTPGSGTASSSPGASP

SEQ ID NO: 122 - protein, 1024 aa, Artificial Sequence
  Description of Artificial Sequence: Synthetic polypeptide
GSSTPSGATGSPGTPGSGTASSSPGTPGSGTASSSPGASPGTSSTGSPGSSTPSGATGSPGTPGSGTASSSPGSSTPSGATGSPGSSPSASTGTGPGSSTPSGATGSPGTPGSGTASSSPGTPGSGTASSSPGSSPSASTGTGPGSSTPSGATGSPGSSPSASTGTGPGTPGSGTASSSPGASPGTSSTGSPGSSTPSGATGSPGASPGTSSTGSPGTPGSGTASSSPGSSTPSGATGSPGTPGSGTASSSPGSSPSASTGTGPGASPGTSSTGSPGASPGTSSTGSPGTPGSGTASSSPGSSTPSGATGSPGSSTPSGATGSPGSSPSASTGTGPGSSPSASTGTGPGASPGTSSTGSPGTPGSGTASSSPGTPGSGTASSSPGSSPSASTGTGPGASPGTSSTGSPGASPGTSSTGSPGTPGSGTASSSPGSSPSASTGTGPGASPGTSSTGSPGASPGTSSTGSPGSSTPSGATGSPGSSPSASTGTGPGSSPSASTGTGPGTPGSGTASSSPGTPGSGTASSSPGASPGTSSTGSPGSSTPSGATGSPGTPGSGTASSSPGASPGTSSTGSPGTPGSGTASSSPGTPGSGTASSSPGSSTPSGATGSPGSSTPSGATGSPGTPGSGTASSSPGSSPSASTGTGPGSSTPSGATGSPGSSTPSGATGSPGSSPSASTGTGPGTPGSGTASSSPGSSPSASTGTGPGASPGTSSTGSPGSSPSASTGTGPGTPGSGTASSSPGASPGTSSTGSPGASPGTSSTGSPGTPGSGTASSSPGTPGSGTASSSPGSSTPSGATGSPGTPGSGTASSSPGASPGTSSTGSPGSSTPSGATGSPGSSTPSGATGSPGSSTPSGATGSPGTPGSGTASSSPGSSPSASTGTGPGSSPSASTGTGPGSSPSASTGTGPGASPGTSSTGSPGASPGTSSTGSPGSSPSASTGTGPGTPGSGTASSSPGASPGTSSTGSPGSSTPSGATGSPGASPGTSSTGSPGASPGTSSTGSPGSSTPSGATGSPGTPG

SEQ ID NO: 123 - protein, 1024 aa, Artificial Sequence
  Description of Artificial Sequence: Synthetic polypeptide
GSSTPSGATGSPGSSTPSGATGSPGTPGSGTASSSPGSSPSASTGTGPGTPGSGTASSSPGASPGTSSTGSPGSSTPSGATGSPGASPGTSSTGSPGTPGSGTASSSPGASPGTSSTGSPGSSPSASTGTGPGTPGSGTASSSPGASPGTSSTGSPGSSTPSGATGSPGSSPSASTGTGPGSSTPSGATGSPGASPGTSSTGSPGASPGTSSTGSPGASPGTSSTGSPGSSTPSGATGSPGASPGTSSTGSPGTPGSGTASSSPGSSTPSGATGSPGSSTPSGATGSPGSSPSASTGTGPGSSPSASTGTGPGSSTPSGATGSPGSSPSASTGTGPGSSPSASTGTGPGASPGTSSTGSPGASPGTSSTGSPGTPGSGTASSSPGSSPSASTGTGPGSSPSASTGTGPGASPGTSSTGSPGSSPSASTGTGPGTPGSGTASSSPGSSPSASTGTGPGSSTPSGATGSPGASPGTSSTGSPGSSTPSGATGSPGTPGSGTASSSPGSSPSASTGTGPGASPGTSSTGSPGSSTPSGATGSPGASPGTSSTGSPGASPGTSSTGSPGTPGSGTASSSPGASPGTSSTGSPGASPGTSSTGSPGSSTPSGATGSPGTPGSGTASSSPGSSPSASTGTGPGSSTPSGATGSPGTPGSGTASSSPGSSTPSGATGSPGSSTPSGATGSPGSSPSASTGTGPGSSPSASTGTGPGSSTPSGATGSPGASPGTSSTGSPGSSPSASTGTGPGTPGSGTASSSPGASPGTSSTGSPGSSPSASTGTGPGSSTPSGATGSPGSSPSASTGTGPGSSTPSGATGSPGSSPSASTGTGPGTPGSGTASSSPGTPGSGTASSSPGSSTPSGATGSPGSSTPSGATGSPGTPGSGTASSSPGSSPSASTGTGPGSSTPSGATGSPGSSPSASTGTGPGSSPSASTGTGPGSSTPSGATGSPGASPGTSSTGSPGASPGTSSTGSPGTPGSGTASSSPGTPGSGTASSSPGTPGSGTASSSPGSSTPSGATGSPGSST

SEQ ID NO: 124 - protein, 1024 aa, Artificial Sequence
  Description of Artificial Sequence: Synthetic polypeptide
GASPGTSSTGSPGSSPSASTGTGPGSSTPSGATGSPGSSPSASTGTGPGTPGSGTASSSPGSSTPSGATGSPGSSTPSGATGSPGSSPSASTGTGPGSSTPSGATGSPGTPGSGTASSSPGSSPSASTGTGPGSSTPSGATGSPGASPGTSSTGSPGSSPSASTGTGPGSSPSASTGTGPGTPGSGTASSSPGASPGTSSTGSPGSSTPSGATGSPGSSPSASTGTGPGASPGTSSTGSPGSSTPSGATGSPGTPGSGTASSSPGSSPSASTGTGPGSSPSASTGTGPGSSPSASTGTGPGTPGSGTASSSPGTPGSGTASSSPGSSTPSGATGSPGTPGSGTASSSPGSSPSASTGTGPGASPGTSSTGSPGASPGTSSTGSPGTPGSGTASSSPGSSPSASTGTGPGASPGTSSTGSPGTPGSGTASSSPGSSTPSGATGSPGSSTPSGATGSPGASPGTSSTGSPGTPGSGTASSSPGSSPSASTGTGPGTPGSGTASSSPGASPGTSSTGSPGSSTPSGATGSPGASPGTSSTGSPGASPGTSSTGSPGTPGSGTASSSPGTPGSGTASSSPGSSPSASTGTGPGSSPSASTGTGPGSSPSASTGTGPGTPGSGTASSSPGASPGTSSTGSPGSSTPSGATGSPGASPGTSSTGSPGSSPSASTGTGPGASPGTSSTGSPGSSPSASTGTGPGASPGTSSTGSPGSSPSASTGTGPGSSPSASTGTGPGTPGSGTASSSPGASPGTSSTGSPGTPGSGTASSSPGTPGSGTASSSPGASPGTSSTGSPGSSTPSGATGSPGSSTPSGATGSPGSSPSASTGTGPGSSTPSGATGSPGTPGSGTASSSPGSSPSASTGTGPGSSTPSGATGSPGSSTPSGATGSPGSSPSASTGTGPGSSPSASTGTGPGASPGTSSTGSPGTPGSGTASSSPGSSPSASTGTGPGSSTPSGATGSPGASPGTSSTGSPGASPGTSSTGSPGSSPSASTGTGPGASPGTSSTGSPGASPGTSSTGSPGTPG

SEQ ID NO: 125 - protein, 1024 aa, Artificial Sequence
  Description of Artificial Sequence: Synthetic polypeptide
GSSTPSGATGSPGSSPSASTGTGPGASPGTSSTGSPGASPGTSSTGSPGTPGSGTASSSPGSSPSASTGTGPGASPGTSSTGSPGSSTPSGATGSPGSSTPSGATGSPGASPGTSSTGSPGSSPSASTGTGPGTPGSGTASSSPGTPGSGTASSSPGASPGTSSTGSPGSSTPSGATGSPGSSTPSGATGSPGSSPSASTGTGPGTPGSGTASSSPGASPGTSSTGSPGSSTPSGATGSPGTPGSGTASSSPGSSPSASTGTGPGSSTPSGATGSPGTPGSGTASSSPGSSPSASTGTGPGTPGSGTASSSPGASPGTSSTGSPGSSTPSGATGSPGSSTPSGATGSPGTPGSGTASSSPGSSTPSGATGSPGSSTPSGATGSPGASPGTSSTGSPGASPGTSSTGSPGASPGTSSTGSPGSSTPSGATGSPGTPGSGTASSSPGSSPSASTGTGPGTPGSGTASSSPGASPGTSSTGSPGTPGSGTASSSPGASPGTSSTGSPGSSTPSGATGSPGSSPSASTGTGPGSSPSASTGTGPGTPGSGTASSSPGASPGTSSTGSPGASPGTSSTGSPGTPGSGTASSSPGASPGTSSTGSPGSSTPSGATGSPGSSTPSGATGSPGSSPSASTGTGPGASPGTSSTGSPGASPGTSSTGSPGTPGSGTASSSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSTPSGATGSPGTPGSGTASSSPGSSPSASTGTGPGASPGTSSTGSPGSSTPSGATGSPGTPGSGTASSSPGSSTPSGATGSPGSSTPSGATGSPGSSTPSGATGSPGSSPSASTGTGPGSSPSASTGTGPGSSTPSGATGSPGSSPSASTGTGPGSSPSASTGTGPGSSTPSGATGSPGASPGTSSTGSPGASPGTSSTGSPGTPGSGTASSSPGASPGTSSTGSPGSSTPSGATGSPGASP

SEQ ID NO: 126 - protein, 1024 aa, Artificial Sequence
  Description of Artificial Sequence: Synthetic polypeptide
GSSPSASTGTGPGSSPSASTGTGPGSSPSASTGTGPGTPGSGTASSSPGSSPSASTGTGPGSSPSASTGTGPGASPGTSSTGSPGSSPSASTGTGPGTPGSGTASSSPGTPGSGTASSSPGASPGTSSTGSPGTPGSGTASSSPGTPGSGTASSSPGSSPSASTGTGPGSSTPSGATGSPGSSPSASTGTGPGASPGTSSTGSPGSSPSASTGTGPGASPGTSSTGSPGASPGTSSTGSPGTPGSGTASSSPGTPGSGTASSSPGASPGTSSTGSPGTPGSGTASSSPGTPGSGTASSSPGSSPSASTGTGPGSSTPSGATGSPGASPGTSSTGSPGSSTPSGATGSPGSSPSASTGTGPGSSPSASTGTGPGSSTPSGATGSPGASPGTSSTGSPGSSPSASTGTGPGTPGSGTASSSPGASPGTSSTGSPGASPGTSSTGSPGTPGSGTASSSPGTPGSGTASSSPGSSTPSGATGSPGTPGSGTASSSPGASPGTSSTGSPGSSTPSGATGSPGTPGSGTASSSPGSSPSASTGTGPGSSPSASTGTGPGSSTPSGATGSPGASPGTSSTGSPGASPGTSSTGSPGTPGSGTASSSPGTPGSGTASSSPGSSTPSGATGSPGSSPSASTGTGPGSSPSASTGTGPGASPGTSSTGSPGASPGTSSTGSPGSSTPSGATGSPGASPGTSSTGSPGASPGTSSTGSPGTPGSGTASSSPGTPGSGTASSSPGTPGSGTASSSPGSSTPSGATGSPGSSTPSGATGSPGSSPSASTGTGPGSSPSASTGTGPGSSTPSGATGSPGTPGSGTASSSPGSSPSASTGTGPGASPGTSSTGSPGSSTPSGATGSPGSSPSASTGTGPGSSTPSGATGSPGASPGTSSTGSPGSSPSASTGTGPGTPGSGTASSSPGSSPSASTGTGPGSSTPSGATGSPGASPGTSSTGSPGSSPSASTGTGPGTPGSGTASSSPGSSTPSGATGSPGSSTPSGATGSPGASPGTSSTGSPGSSPSASTGTGPGSSP

SEQ ID NO: 127 - protein, 1024 aa, Artificial Sequence
  Description of Artificial Sequence: Synthetic polypeptide
GSSPSASTGTGPGTPGSGTASSSPGSSTPSGATGSPGTPGSGTASSSPGSSTPSGATGSPGSSTPSGATGSPGSSPSASTGTGPGSSPSASTGTGPGSSPSASTGTGPGTPGSGTASSSPGASPGTSSTGSPGSSTPSGATGSPGTPGSGTASSSPGTPGSGTASSSPGSSTPSGATGSPGSSTPSGATGSPGSSPSASTGTGPGASPGTSSTGSPGASPGTSSTGSPGASPGTSSTGSPGASPGTSSTGSPGTPGSGTASSSPGTPGSGTASSSPGSSPSASTGTGPGSSTPSGATGSPGASPGTSSTGSPGSSTPSGATGSPGSSTPSGATGSPGSSPSASTGTGPGASPGTSSTGSPGTPGSGTASSSPGSSPSASTGTGPGSSPSASTGTGPGASPGTSSTGSPGASPGTSSTGSPGTPGSGTASSSPGASPGTSSTGSPGTPGSGTASSSPGTPGSGTASSSPGSSTPSGATGSPGTPGSGTASSSPGASPGTSSTGSPGSSTPSGATGSPGSSTPSGATGSPGSSPSASTGTGPGSSTPSGATGSPGSSTPSGATGSPGASPGTSSTGSPGSSPSASTGTGPGTPGSGTASSSPGASPGTSSTGSPGSSPSASTGTGPGTPGSGTASSSPGSSPSASTGTGPGTPGSGTASSSPGASPGTSSTGSPGASPGTSSTGSPGTPGSGTASSSPGTPGSGTASSSPGSSTPSGATGSPGSSTPSGATGSPGTPGSGTASSSPGSSTPSGATGSPGSSTPSGATGSPGASPGTSSTGSPGSSPSASTGTGPGSSTPSGATGSPGSSPSASTGTGPGSSPSASTGTGPGASPGTSSTGSPGSSTPSGATGSPGASPGTSSTGSPGTPGSGTASSSPGTPGSGTASSSPGSSPSASTGTGPGASPGTSSTGSPGSSTPSGATGSPGSSPSASTGTGPGSSPSASTGTGPGASPGTSSTGSPGTPGSGTASSSPGSSTPSGATGSPGTPGSGTASSSPGSSPSASTGTGPGSSPSASTGTGPGASP

SEQ ID NO: 128 - protein, 72 aa, Artificial Sequence
  Description of Artificial Sequence: Synthetic polypeptide
SPAGSPTSTEEGSPAGSPTSTEEGTSESATPESGPGTSTEPSEGSAPGTSESATPESGPGSEPATSGSETPG

SEQ ID NO: 129 - protein, 72 aa, Artificial Sequence
  Description of Artificial Sequence: Synthetic polypeptide
TSESATPESGPGTSESATPESGPGSEPATSGSETPGSEPATSGSETPGSPAGSPTSTEEGTSTEPSEGSAPG

SEQ ID NO: 130 - protein, 108 aa, Artificial Sequence
  Description of Artificial Sequence: Synthetic polypeptide
TEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTS

SEQ ID NO: 131 - protein, 108 aa, Artificial Sequence
  Description of Artificial Sequence: Synthetic polypeptide
GSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAP

SEQ ID NO: 132 - protein, 144 aa, Artificial Sequence
  Description of Artificial Sequence: Synthetic polypeptide
STEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGS

SEQ ID NO: 133 - protein, 144 aa, Artificial Sequence
  Description of Artificial Sequence: Synthetic polypeptide
SEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPG

SEQ ID NO: 134 - protein, 180 aa, Artificial Sequence
  Description of Artificial Sequence: Synthetic polypeptide
TSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 135 - protein, 216 aa, Artificial Sequence
  Description of Artificial Sequence: Synthetic polypeptide
PESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 136 - protein, 252 aa, Artificial Sequence
  Description of Artificial Sequence: Synthetic polypeptide
ESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 137 - protein, 288 aa, Artificial Sequence
  Description of Artificial Sequence: Synthetic polypeptide
TPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 138 - protein, 324 aa, Artificial Sequence
  Description of Artificial Sequence: Synthetic polypeptide
PESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 139 - protein, 360 aa, Artificial Sequence
  Description of Artificial Sequence: Synthetic polypeptide
PESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 140 - protein, 360 aa, Artificial Sequence
  Description of Artificial Sequence: Synthetic polypeptide
PESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPS

SEQ ID NO: 141 - protein, 432 aa, Artificial Sequence
  Description of Artificial Sequence: Synthetic polypeptide
EGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 142 - protein, 468 aa, Artificial Sequence
  Description of Artificial Sequence: Synthetic polypeptide
EGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 143 - protein, 504 aa, Artificial Sequence
  Description of Artificial Sequence: Synthetic polypeptide
EGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 144 - protein, 540 aa, Artificial Sequence
  Description of Artificial Sequence: Synthetic polypeptide
TPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEP

SEQ ID NO: 145 - protein, 576 aa, Artificial Sequence
  Description of Artificial Sequence: Synthetic polypeptide
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 146 - protein, 612 aa, Artificial Sequence
  Description of Artificial Sequence: Synthetic polypeptide
GSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 147 - protein, 648 aa, Artificial Sequence
  Description of Artificial Sequence: Synthetic polypeptide
PESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 148 - protein, 684 aa, Artificial Sequence
  Description of Artificial Sequence: Synthetic polypeptide
EGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 149 - protein, 720 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTE

SEQ ID NO: 150 - protein, 756 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSES

SEQ ID NO: 151 - protein, 792 aa, Artificial Sequence
  Description of Artificial Sequence: Synthetic polypeptide
EGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 152 - protein, 828 aa, Artificial Sequence
  Description of Artificial Sequence: Synthetic polypeptide
PESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 153 - protein, 72 aa, Artificial Sequence
  Description of Artificial Sequence: Synthetic polypeptide
GPGSSPSASTGTGPGTPGSGTASSSPGSSTPSGATGSPGSSPSASTGTGPGASPGTSSTGSPGTPGSGTASS

SEQ ID NO: 154 - protein, 72 aa, Artificial Sequence
  Description of Artificial Sequence: Synthetic polypeptide
GSSTPSGATGSPGSSTPSGATGSPGSSPSASTGTGPGSSPSASTGTGPGASPGTSSTGSPGTPGSGTASSSP

SEQ ID NO: 155 - protein, 72 aa, Artificial Sequence
  Description of Artificial Sequence: Synthetic polypeptide
SPSASTGTGPGASPGTSSTGSPGSSPSASTGTGPGTPGSGTASSSPGSSTPSGATGSPGSSTPSGATGSPGA

SEQ ID NO: 156 - protein, 108 aa, Artificial Sequence
  Description of Artificial Sequence: Synthetic polypeptide
SASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASP

SEQ ID NO: 157 - protein, 108 aa, Artificial Sequence
  Description of Artificial Sequence: Synthetic polypeptide
PGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSS

SEQ ID NO: 158 - protein, 144 aa, Artificial Sequence; identical to SEQ ID NO: 78
  Description of Artificial Sequence: Synthetic polypeptide

SEQ ID NO: 159 - protein, 144 aa, Artificial Sequence
  Description of Artificial Sequence: Synthetic polypeptide
PSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASP

SEQ ID NO: 160 - protein, 180 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGS

SEQ ID NO: 161 - protein, 216 aa, Artificial Sequence
  Description of Artificial Sequence: Synthetic polypeptide
TGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSG

SEQ ID NO: 162 - protein, 252 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPG

SEQ ID NO: 163 - protein, 288 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGS

SEQ ID NO: 164 - protein, 324 aa, Artificial Sequence
  Description of Artificial Sequence: Synthetic polypeptide
TSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 165 - protein, 360 aa, Artificial Sequence
  Description of Artificial Sequence: Synthetic polypeptide
TSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 166 - protein, 396 aa, Artificial Sequence
  Description of Artificial Sequence: Synthetic polypeptide
GATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGT

SEQ ID NO: 167 - protein, 432 aa, Artificial Sequence
  Description of Artificial Sequence: Synthetic polypeptide
GATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPS

SEQ ID NO: 168 - protein, 468 aa, Artificial Sequence
  Description of Artificial Sequence: Synthetic polypeptide
TSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPG

SEQ ID NO: 169 - protein, 504 aa, Artificial Sequence
  Description of Artificial Sequence: Synthetic polypeptide
TSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 170 - protein, 540 aa, Artificial Sequence
  Description of Artificial Sequence: Synthetic polypeptide
TSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 171 - protein, 576 aa, Artificial Sequence
  Description of Artificial Sequence: Synthetic polypeptide
TSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 172 - protein, 612 aa, Artificial Sequence
  Description of Artificial Sequence: Synthetic polypeptide
STGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTS

SEQ ID NO: 173 - protein, 648 aa, Artificial Sequence
  Description of Artificial Sequence: Synthetic polypeptide
GTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 174 - protein, 684 aa, Artificial Sequence
  Description of Artificial Sequence: Synthetic polypeptide
TSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 175 - protein, 720 aa, Artificial Sequence
  Description of Artificial Sequence: Synthetic polypeptide
TSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 176 - protein, 756 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPG

SEQ ID NO: 177 - protein, 792 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPG

SEQ ID NO: 178 - protein, 828 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 179 - protein, 869 aa, Artificial Sequence
  Description of Artificial Sequence: Synthetic polypeptide
GSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGR

SEQ ID NO: 180 - protein, 144 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASR

SEQ ID NO: 181 - protein, 288 aa, Artificial Sequence
  Description of Artificial Sequence: Synthetic polypeptide
SAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 182 - protein, 432 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTESASR

SEQ ID NO: 183 - protein, 576 aa, Artificial Sequence
  Description of Artificial Sequence: Synthetic polypeptide
SAGSPTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 184 - protein, 864 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASR

SEQ ID NO: 185 - protein, 864 aa, Artificial Sequence
  Description of Artificial Sequence: Synthetic polypeptide
SAGSPGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGSTSSTAESPGPGTSPSGESSTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGSTSSTAESPGPGTSPSGESSTAPGSTSESPSGTAPGSTSESPSGTAPGTSTPESGSASPGSTSESPSGTAPGSTSESPSGTAPGTSTPESGSASPGSTSESPSGTAPGSTSESPSGTAPGSTSESPSGTAPGSTSSTAESPGPGTSPSGESSTAPGTSSASR

SEQ ID NO: 186 - protein, 864 aa, Artificial Sequence
  Description of Artificial Sequence: Synthetic polypeptide
SAGSPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASSASR

SEQ ID NO: 187 - protein, 11 aa, Artificial Sequence
  Description of Artificial Sequence: Synthetic peptide
GGSPAGSCTSP

SEQ ID NO: 188 - protein, 11 aa, Artificial Sequence
  Description of Artificial Sequence: Synthetic peptide
GASASCAPSTG

SEQ ID NO: 189 - protein, 13 aa, Artificial Sequence
  Description of Artificial Sequence: Synthetic peptide
TAEAAGCGTAEAA

SEQ ID NO: 190 - protein, 11 aa, Artificial Sequence
  Description of Artificial Sequence: Synthetic peptide
GPEPTCPAPSG

SEQ ID NO: 191 - protein, 11 aa, Artificial Sequence
  Description of Artificial Sequence: Synthetic peptide
GGSPAGSKTSP

SEQ ID NO: 192 - protein, 11 aa, Artificial Sequence
  Description of Artificial Sequence: Synthetic peptide
GASASKAPSTG

SEQ ID NO: 193 - protein, 879 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPR

SEQ ID NO: 194 - protein, 892 aa, Artificial Sequence
  Description of Artificial Sequence: Synthetic polypeptide
ATAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 195 - protein, 905 aa, Artificial Sequence
  Description of Artificial Sequence: Synthetic polypeptide
ATAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 196 - protein, 918 aa, Artificial Sequence
  Description of Artificial Sequence: Synthetic polypeptide
ATAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPTAEAAGCGTAEAAGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPTAEAAGCGTAEAAGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 197 - protein, 931 aa, Artificial Sequence
  Description of Artificial Sequence: Synthetic polypeptide
ATAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPTAEAAGCGTAEAAGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPTAEAAGCGTAEAAGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 198 - protein, 944 aa, Artificial Sequence
  Description of Artificial Sequence: Synthetic polypeptide
ATAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTETAEAAGCGTAEAAPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSTAEAAGCGTAEAAAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSTAEAAGCGTAEAAPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATTAEAAGCGTAEAAPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 199 - protein, 957 aa, Artificial Sequence
  Description of Artificial Sequence: Synthetic polypeptide
ATAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPTAEAAGCGTAEAAGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPTAEAAGCGTAEAAGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPTAEAAGCGTAEAAGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEETAEAAGCGTAEAAGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 200 - protein, 970 aa, Artificial Sequence
  Description of Artificial Sequence: Synthetic polypeptide
ATAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSTAEAAGCGTAEAAESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSTAEAAGCGTAEAAEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSTAEAAGCGTAEAAAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTTAEAAGCGTAEAASTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATAEAAGCGTAEAATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPETAEAAGCGTAEAASGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 201 - protein, 879 aa, Artificial Sequence
  Description of Artificial Sequence: Synthetic polypeptide
ATAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPR

SEQ ID NO: 202 - protein, 879 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 203 - protein, 892 aa, Artificial Sequence
  Description of Artificial Sequence: Synthetic polypeptide
ATAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPR

SEQ ID NO: 204 - protein, 892 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTTAEAAGCGTAEAAEPSEGSAPGSPAGSPTSTEEGTSTEPSEGSAPGTSESATPESGPGSEPATTAEAAGCGTAEAASGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPR

SEQ ID NO: 205 - protein, 892 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 206 - protein, 871 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGGKPGGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPR

SEQ ID NO: 207 - protein, 876 aa, Artificial Sequence
  Description of Artificial Sequence: Synthetic polypeptide
AGGKPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGKPGR

SEQ ID NO: 208 - protein, 881 aa, Artificial Sequence
  Description of Artificial Sequence: Synthetic polypeptide
AGGKPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGGKPGGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGKPGR

SEQ ID NO: 209 - protein, 886 aa, Artificial Sequence
  Description of Artificial Sequence: Synthetic polypeptide
AGGKPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGGKPGGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGKPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGKPGR

SEQ ID NO: 210 - protein, 891 aa, Artificial Sequence
  Description of Artificial Sequence: Synthetic polypeptide
AGGKPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGGKPGGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGGKPGGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGGKPGGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGKPGR

SEQ ID NO: 211 - protein, 896 aa, Artificial Sequence
  Description of Artificial Sequence: Synthetic polypeptide
AGGKPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEGGKPGPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSGGKPGAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSGGKPGPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATGGKPGPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGKPGR

SEQ ID NO: 212 - protein, 901 aa, Artificial Sequence
  Description of Artificial Sequence: Synthetic polypeptide
AGGKPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGGKPGGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGGKPGGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGGKPGGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGKPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGGKPGGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGKPGR

SEQ ID NO: 213 - protein, 906 aa, Artificial Sequence
  Description of Artificial Sequence: Synthetic polypeptide
AGGKPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSGGKPGESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSGGKPGEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSGGKPGAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTGGKPGSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPAGGKPGTSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPEGGKPGSGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGKPGR

SEQ ID NO: 214 - protein, 871 aa, Artificial Sequence
  Description of Artificial Sequence: Synthetic polypeptide
AGGKPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPR

SEQ ID NO: 215 - protein, 871 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGKPGR

SEQ ID NO: 216 - protein, 876 aa, Artificial Sequence
  Description of Artificial Sequence: Synthetic polypeptide
AGGKPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGGKPGGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPR

SEQ ID NO: 217 - protein, 876 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTGGKPGEPSEGSAPGSPAGSPTSTEEGTSTEPSEGSAPGTSESATPESGPGSEPATGGKPGSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPR

SEQ ID NO: 218 - protein, 876 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGGKPGGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGKPGR

SEQ ID NO: 219 - protein, 888 aa, Artificial Sequence
  Description of Artificial Sequence: Synthetic polypeptide
AEATTAAGGAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPR

SEQ ID NO: 220 - protein, 901 aa, Artificial Sequence
  Description of Artificial Sequence: Synthetic polypeptide
AEATTAAGGATAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 221 - protein, 914 aa, Artificial Sequence
  Description of Artificial Sequence: Synthetic polypeptide
AEATTAAGGATAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 222 - protein, 927 aa, Artificial Sequence
  Description of Artificial Sequence: Synthetic polypeptide
AEATTAAGGATAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPTAEAAGCGTAEAAGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPTAEAAGCGTAEAAGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 223 - protein, 890 aa, Artificial Sequence
  Description of Artificial Sequence: Synthetic polypeptide
ATGTATSEGSPEGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPR

SEQ ID NO: 224 - protein, 903 aa, Artificial Sequence
  Description of Artificial Sequence: Synthetic polypeptide
ATGTATSEGSPETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 225 - protein, 916 aa, Artificial Sequence
  Description of Artificial Sequence: Synthetic polypeptide
ATGTATSEGSPETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 226 - protein, 929 aa, Artificial Sequence
  Description of Artificial Sequence: Synthetic polypeptide
ATGTATSEGSPETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPTAEAAGCGTAEAAGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPTAEAAGCGTAEAAGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 227 - protein, 890 aa, Artificial Sequence
  Description of Artificial Sequence: Synthetic polypeptide
EPTAATTGESAGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPR

SEQ ID NO: 228 - protein, 903 aa, Artificial Sequence
  Description of Artificial Sequence: Synthetic polypeptide
EPTAATTGESAGTAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 229 - protein, 916 aa, Artificial Sequence
  Description of Artificial Sequence: Synthetic polypeptide
EPTAATTGESAGTAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 230 - protein, 929 aa, Artificial Sequence
  Description of Artificial Sequence: Synthetic polypeptide
EPTAATTGESAGTAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPTAEAAGCGTAEAAGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPTAEAAGCGTAEAAGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 231 - protein, 891 aa, Artificial Sequence
  Description of Artificial Sequence: Synthetic polypeptide
AEATTAAGGAEEEGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPR

SEQ ID NO: 232 - protein, 904 aa, Artificial Sequence
  Description of Artificial Sequence: Synthetic polypeptide
AEATTAAGGAEEETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 233 - protein, 917 aa, Artificial Sequence
  Description of Artificial Sequence: Synthetic polypeptide
AEATTAAGGAEEETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 234 - protein, 930 aa, Artificial Sequence
  Description of Artificial Sequence: Synthetic polypeptide
AEATTAAGGAEEETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPTAEAAGCGTAEAAGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPTAEAAGCGTAEAAGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 235 - protein, 893 aa, Artificial Sequence
  Description of Artificial Sequence: Synthetic polypeptide
ATGTATSEGSPEEEEGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPR

SEQ ID NO: 236 - protein, 906 aa, Artificial Sequence
  Description of Artificial Sequence: Synthetic polypeptide
ATGTATSEGSPEEEETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 237 - protein, 919 aa, Artificial Sequence
  Description of Artificial Sequence: Synthetic polypeptide
ATGTATSEGSPEEEETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 238 - protein, 932 aa, Artificial Sequence
  Description of Artificial Sequence: Synthetic polypeptide
ATGTATSEGSPEEEETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPTAEAAGCGTAEAAGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPTAEAAGCGTAEAAGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 239 - protein, 898 aa, Artificial Sequence
  Description of Artificial Sequence: Synthetic polypeptide
AEATTAAGGAEEEGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPRPRPRPRP

SEQ ID NO: 240 - protein, 911 aa, Artificial Sequence
  Description of Artificial Sequence: Synthetic polypeptide
AEATTAAGGAEEETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAARPRPRPRP

SEQ ID NO: 241 - protein, 924 aa, Artificial Sequence
  Description of Artificial Sequence: Synthetic polypeptide
AEATTAAGGAEEETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAARPRPRPRP

SEQ ID NO: 242 - protein, 937 aa, Artificial Sequence
  Description of Artificial Sequence: Synthetic polypeptide
AEATTAAGGAEEETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPTAEAAGCGTAEAAGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPTAEAAGCGTAEAAGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAARPRPRPRP

SEQ ID NO: 243 - protein, 891 aa, Artificial Sequence; identical to SEQ ID NO: 231
  Description of Artificial Sequence: Synthetic polypeptide

SEQ ID NO: 244 - protein, 904 aa, Artificial Sequence; identical to SEQ ID NO: 232
  Description of Artificial Sequence: Synthetic polypeptide

SEQ ID NO: 245 - protein, 917 aa, Artificial Sequence; identical to SEQ ID NO: 233
  Description of Artificial Sequence: Synthetic polypeptide

SEQ ID NO: 246 - protein, 930 aa, Artificial Sequence; identical to SEQ ID NO: 234
  Description of Artificial Sequence: Synthetic polypeptide

SEQ ID NO: 247 - protein, 914 aa, Artificial Sequence
  Description of Artificial Sequence: Synthetic polypeptide
AEATTAAGGAEEETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGGKPGGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPTAEAAGCGTAEAAGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGKPGR

SEQ ID NO: 248 - protein, 922 aa, Artificial Sequence
  Description of Artificial Sequence: Synthetic polypeptide
AEATTAAGGAEEETAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPTAEAAGCGTAEAAGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPTAEAAGCGTAEAAGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGKPGR

SEQ ID NO: 249 - protein, 906 aa, Artificial Sequence
  Description of Artificial Sequence: Synthetic polypeptide
AEATTAAGGAEEEGGKPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGGKPGGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGKPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAAR

SEQ ID NO: 250 - protein, 914 aa, Artificial Sequence; identical to SEQ ID NO: 247
  Description of Artificial Sequence: Synthetic polypeptide

SEQ ID NO: 251 - protein, 603 aa, Artificial Sequence
  Description of Artificial Sequence: Synthetic polypeptide
AEATTAAGGAEEEGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPTAEAAGCGTAEAAR

SEQ ID NO: 252 - protein, 459 aa, Artificial Sequence
  Description of Artificial Sequence: Synthetic polypeptide
AEATTAAGGAEEEGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAR

SEQ ID NO: 253 - protein, 315 aa, Artificial Sequence
  Description of Artificial Sequence: Synthetic polypeptide
AEATTAAGGAEEEGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPTAEAAGCGTAEAAR

SEQ ID NO: 254 - protein, 171 aa, Artificial Sequence
  Description of Artificial Sequence: Synthetic polypeptide
AEATTAAGGAEEEGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPTAEAAGCGTAEAAR

SEQ ID NO: 255 - protein, 603 aa, Artificial Sequence; identical to SEQ ID NO: 251
  Description of Artificial Sequence: Synthetic polypeptide

SEQ ID NO: 256 - protein, 459 aa, Artificial Sequence; identical to SEQ ID NO: 252
  Description of Artificial Sequence: Synthetic polypeptide

SEQ ID NO: 257 - protein, 315 aa, Artificial Sequence; identical to SEQ ID NO: 253
  Description of Artificial Sequence: Synthetic polypeptide

SEQ ID NO: 258 - protein, 171 aa, Artificial Sequence; identical to SEQ ID NO: 254
  Description of Artificial Sequence: Synthetic polypeptide

SEQ ID NO: 259 - protein, 595 aa, Artificial Sequence
  Description of Artificial Sequence: Synthetic polypeptide
AEATTAAGGAEEEGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGKPGR

SEQ ID NO: 260 - protein, 451 aa, Artificial Sequence
  Description of Artificial Sequence: Synthetic polypeptide
AEATTAAGGAEEEGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGGKPGR

SEQ ID NO: 261 - protein, 307 aa, Artificial Sequence
  Description of Artificial Sequence: Synthetic polypeptide
AEATTAAGGAEEEGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGGKPGR

SEQ ID NO: 262 - protein, 163 aa, Artificial Sequence
  Description of Artificial Sequence: Synthetic polypeptide
AEATTAAGGAEEEGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGGKPGR

SEQ ID NO: 263 - protein, 595 aa, Artificial Sequence; identical to SEQ ID NO: 259
  Description of Artificial Sequence: Synthetic polypeptide

SEQ ID NO: 264 - protein, 451 aa, Artificial Sequence; identical to SEQ ID NO: 260
  Description of Artificial Sequence: Synthetic polypeptide

SEQ ID NO: 265 - protein, 307 aa, Artificial Sequence; identical to SEQ ID NO: 261
  Description of Artificial Sequence: Synthetic polypeptide

SEQ ID NO: 266 - protein, 163 aa, Artificial Sequence; identical to SEQ ID NO: 262
  Description of Artificial Sequence: Synthetic polypeptide

SEQ ID NO: 267 - protein, 879 aa, Artificial Sequence
  Description of Artificial Sequence: Synthetic polypeptide
AGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPR

SEQ ID NO: 268 - protein, 892 aa, Artificial Sequence
  Description of Artificial Sequence: Synthetic polypeptide
ATAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 269 - protein, 905 aa, Artificial Sequence
  Description of Artificial Sequence: Synthetic polypeptide
ATAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 270 - protein, 918 aa, Artificial Sequence
  Description of Artificial Sequence: Synthetic polypeptide
ATAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPTAEAAGCGTAEAAGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPTAEAAGCGTAEAAGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 271 - protein, 931 aa, Artificial Sequence
  Description of Artificial Sequence: Synthetic polypeptide
ATAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPTAEAAGCGTAEAAGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPTAEAAGCGTAEAAGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 272 - protein, 944 aa, Artificial Sequence
  Description of Artificial Sequence: Synthetic polypeptide
ATAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTAEAAGCGTAEAATSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTTAEAAGCGTAEAAGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTTAEAAGCGTAEAAPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSTAEAAGCGTAEAASTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 273 - protein, 957 aa, Artificial Sequence
  Description of Artificial Sequence: Synthetic polypeptide
ATAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPTAEAAGCGTAEAAGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPTAEAAGCGTAEAAGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPTAEAAGCGTAEAAGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPTAEAAGCGTAEAAGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 274 - protein, 970 aa, Artificial Sequence
  Description of Artificial Sequence: Synthetic polypeptide
ATAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASTAEAAGCGTAEAAPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGTAEAAGCGTAEAAATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGTAEAAGCGTAEAASPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGATAEAAGCGTAEAASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPTAEAAGCGTAEAASGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTAEAAGCGTAEAATGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 275 - protein, 879 aa, Artificial Sequence
  Description of Artificial Sequence: Synthetic polypeptide
ATAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPR

SEQ ID NO: 276 - protein, 879 aa, Artificial Sequence
  Description of Artificial Sequence: Synthetic polypeptide
AGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 277 - protein, 892 aa, Artificial Sequence
  Description of Artificial Sequence: Synthetic polypeptide
ATAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPR

SEQ ID NO: 278 - protein, 892 aa, Artificial Sequence
  Description of Artificial Sequence: Synthetic polypeptide
AGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTTAEAAGCGTAEAAPSGATGSPGSSTPSGATGSPGASPGTSSTGSPGTPGSGTASSSPGSSTPSTAEAAGCGTAEAAGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPR

SEQ ID NO: 279 - protein, 892 aa, Artificial Sequence
  Description of Artificial Sequence: Synthetic polypeptide
AGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 280 - protein, 871 aa, Artificial Sequence
  Description of Artificial Sequence: Synthetic polypeptide
AGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGGKPGGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPR

SEQ ID NO: 281 - protein, 876 aa, Artificial Sequence
  Description of Artificial Sequence: Synthetic polypeptide
AGGKPGGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGGKPGR

SEQ ID NO: 282 - protein, 881 aa, Artificial Sequence
  Description of Artificial Sequence: Synthetic polypeptide
AGGKPGGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGGKPGGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGGKPGR

SEQ ID NO: 283 - protein, 886 aa, Artificial Sequence
  Description of Artificial Sequence: Synthetic polypeptide
AGGKPGGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGGKPGGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGGKPGGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGGKPGR

SEQ ID NO: 284 - protein, 891 aa, Artificial Sequence
  Description of Artificial Sequence: Synthetic polypeptide
AGGKPGGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGGKPGGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGGKPGGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGGKPGGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGGKPGR

SEQ ID NO: 285 - protein, 896 aa, Artificial Sequence
  Description of Artificial Sequence: Synthetic polypeptide
AGGKPGGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGGGKPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGGKPGGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTGGKPGPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSGGKPGSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGGKPGR

SEQ ID NO: 286 - protein, 901 aa, Artificial Sequence
  Description of Artificial Sequence: Synthetic polypeptide
AGGKPGGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGGKPGGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGGKPGGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGGKPGGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGGKPGGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGGKPGGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGGKPGR

SEQ ID NO: 287 - protein, 906 aa, Artificial Sequence
  Description of Artificial Sequence: Synthetic polypeptide
AGGKPGGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASGGKPGPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGGGKPGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGGGKPGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGAGGKPGSPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPGGKPGSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGGGKPGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGGKPGR

SEQ ID NO: 288 - protein, 871 aa, Artificial Sequence
  Description of Artificial Sequence: Synthetic polypeptide
AGGKPGGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPR

SEQ ID NO: 289 - protein, 871 aa, Artificial Sequence
  Description of Artificial Sequence: Synthetic polypeptide
AGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGGKPGR

SEQ ID NO: 290 - protein, 876 aa, Artificial Sequence
  Description of Artificial Sequence: Synthetic polypeptide
AGGKPGGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGGKPGGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPR

SEQ ID NO: 291 - protein, 876 aa, Artificial Sequence
  Description of Artificial Sequence: Synthetic polypeptide
AGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTGGKPGPSGATGSPGSSTPSGATGSPGASPGTSSTGSPGTPGSGTASSSPGSSTPSGGKPGGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPR

SEQ ID NO: 292 - protein, 876 aa, Artificial Sequence
  Description of Artificial Sequence: Synthetic polypeptide
AGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGGKPGGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGGKPGR

SEQ ID NO: 293 - protein, 888 aa, Artificial Sequence
  Description of Artificial Sequence: Synthetic polypeptide
AEATTAAGGAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPR

SEQ ID NO: 294 - protein, 901 aa, Artificial Sequence
  Description of Artificial Sequence: Synthetic polypeptide
AEATTAAGGATAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 295 - protein, 914 aa, Artificial Sequence
  Description of Artificial Sequence: Synthetic polypeptide
AEATTAAGGATAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 296 - protein, 927 aa, Artificial Sequence
  Description of Artificial Sequence: Synthetic polypeptide
AEATTAAGGATAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPTAEAAGCGTAEAAGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPTAEAAGCGTAEAAGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 297 - protein, 890 aa, Artificial Sequence
  Description of Artificial Sequence: Synthetic polypeptide
ATGTATSEGSPEGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPR

SEQ ID NO: 298 - protein, 903 aa, Artificial Sequence
  Description of Artificial Sequence: Synthetic polypeptide
ATGTATSEGSPETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 299 - protein, 916 aa, Artificial Sequence
  Description of Artificial Sequence: Synthetic polypeptide
ATGTATSEGSPETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 300 - protein, 929 aa, Artificial Sequence
  Description of Artificial Sequence: Synthetic polypeptide
ATGTATSEGSPETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPTAEAAGCGTAEAAGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPTAEAAGCGTAEAAGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 301 - protein, 890 aa, Artificial Sequence
  Description of Artificial Sequence: Synthetic polypeptide
EPTAATTGESAGGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPR

SEQ ID NO: 302 - protein, 903 aa, Artificial Sequence
  Description of Artificial Sequence: Synthetic polypeptide
EPTAATTGESAGTAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 303 - protein, 916 aa, Artificial Sequence
  Description of Artificial Sequence: Synthetic polypeptide
EPTAATTGESAGTAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 304 - protein, 929 aa, Artificial Sequence
  Description of Artificial Sequence: Synthetic polypeptide
EPTAATTGESAGTAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPTAEAAGCGTAEAAGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPTAEAAGCGTAEAAGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 305 - protein, 891 aa, Artificial Sequence
  Description of Artificial Sequence: Synthetic polypeptide
AEATTAAGGAEEEGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPR

SEQ ID NO: 306 - protein, 904 aa, Artificial Sequence
  Description of Artificial Sequence: Synthetic polypeptide
AEATTAAGGAEEETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 307 - protein, 917 aa, Artificial Sequence
  Description of Artificial Sequence: Synthetic polypeptide
AEATTAAGGAEEETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 308 - protein, 930 aa, Artificial Sequence
  Description of Artificial Sequence: Synthetic polypeptide
AEATTAAGGAEEETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPTAEAAGCGTAEAAGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPTAEAAGCGTAEAAGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 309 - protein, 893 aa, Artificial Sequence
  Description of Artificial Sequence: Synthetic polypeptide
ATGTATSEGSPEEEEGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPR

SEQ ID NO: 310 - protein, 906 aa, Artificial Sequence
  Description of Artificial Sequence: Synthetic polypeptide
ATGTATSEGSPEEEETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 311 - protein, 919 aa, Artificial Sequence
  Description of Artificial Sequence: Synthetic polypeptide
ATGTATSEGSPEEEETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 312 - protein, 932 aa, Artificial Sequence
  Description of Artificial Sequence: Synthetic polypeptide
ATGTATSEGSPEEEETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPTAEAAGCGTAEAAGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPTAEAAGCGTAEAAGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 313 - protein, 898 aa, Artificial Sequence
  Description of Artificial Sequence: Synthetic polypeptide
AEATTAAGGAEEEGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPRPRPRPRP

SEQ ID NO: 314 - protein, 911 aa, Artificial Sequence
  Description of Artificial Sequence: Synthetic polypeptide
AEATTAAGGAEEETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAARPRPRPRP

SEQ ID NO: 315 - protein, 924 aa, Artificial Sequence
  Description of Artificial Sequence: Synthetic polypeptide
AEATTAAGGAEEETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAARPRPRPRP

SEQ ID NO: 316 - protein, 937 aa, Artificial Sequence
  Description of Artificial Sequence: Synthetic polypeptide
AEATTAAGGAEEETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPTAEAAGCGTAEAAGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPTAEAAGCGTAEAAGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAARPRPRPRP

SEQ ID NO: 317 - protein, 891 aa, Artificial Sequence; identical to SEQ ID NO: 305
  Description of Artificial Sequence: Synthetic polypeptide

SEQ ID NO: 318 - protein, 904 aa, Artificial Sequence; identical to SEQ ID NO: 306
  Description of Artificial Sequence: Synthetic polypeptide

SEQ ID NO: 319 - protein, 917 aa, Artificial Sequence; identical to SEQ ID NO: 307
  Description of Artificial Sequence: Synthetic polypeptide

SEQ ID NO: 320 - protein, 930 aa, Artificial Sequence; identical to SEQ ID NO: 308
  Description of Artificial Sequence: Synthetic polypeptide

SEQ ID NO: 321 - protein, 914 aa, Artificial Sequence
  Description of Artificial Sequence: Synthetic polypeptide
AEATTAAGGAEEETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGGKPGGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPTAEAAGCGTAEAAGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGGKPGR

SEQ ID NO: 322 - protein, 922 aa, Artificial Sequence
  Description of Artificial Sequence: Synthetic polypeptide
AEATTAAGGAEEETAEAAGCGTAEAAGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPTAEAAGCGTAEAAGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPTAEAAGCGTAEAAGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGGKPGR

SEQ ID NO: 323 - protein, 906 aa, Artificial Sequence
  Description of Artificial Sequence: Synthetic polypeptide
AEATTAAGGAEEEGGKPGGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGGKPGGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGGKPGGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPTAEAAGCGTAEAAR

SEQ ID NO: 324 - protein, 914 aa, Artificial Sequence; identical to SEQ ID NO: 321
  Description of Artificial Sequence: Synthetic polypeptide

SEQ ID NO: 325 - protein, 603 aa, Artificial Sequence
  Description of Artificial Sequence: Synthetic polypeptide
AEATTAAGGAEEEGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPTAEAAGCGTAEAAR

SEQ ID NO: 326 - protein, 459 aa, Artificial Sequence
  Description of Artificial Sequence: Synthetic polypeptide
AEATTAAGGAEEEGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPTAEAAGCGTAEAAR

SEQ ID NO: 327 - protein, 315 aa, Artificial Sequence
  Description of Artificial Sequence: Synthetic polypeptide
AEATTAAGGAEEEGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPTAEAAGCGTAEAAR

SEQ ID NO: 328 - protein, 171 aa, Artificial Sequence
  Description of Artificial Sequence: Synthetic polypeptide
AEATTAAGGAEEEGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPTAEAAGCGTAEAAR

SEQ ID NO: 329 - protein, 603 aa, Artificial Sequence; identical to SEQ ID NO: 325
  Description of Artificial Sequence: Synthetic polypeptide

SEQ ID NO: 330 - protein, 459 aa, Artificial Sequence; identical to SEQ ID NO: 326
  Description of Artificial Sequence: Synthetic polypeptide

SEQ ID NO: 331 - protein, 315 aa, Artificial Sequence; identical to SEQ ID NO: 327
  Description of Artificial Sequence: Synthetic polypeptide

SEQ ID NO: 332 - protein, 171 aa, Artificial Sequence; identical to SEQ ID NO: 328
  Description of Artificial Sequence: Synthetic polypeptide

SEQ ID NO: 333 - protein, 595 aa, Artificial Sequence
  Description of Artificial Sequence: Synthetic polypeptide
AEATTAAGGAEEEGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGGKPGR

SEQ ID NO: 334 - protein, 451 aa, Artificial Sequence
  Description of Artificial Sequence: Synthetic polypeptide
AEATTAAGGAEEEGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGGKPGR

SEQ ID NO: 335 - protein, 307 aa, Artificial Sequence
  Description of Artificial Sequence: Synthetic polypeptide
AEATTAAGGAEEEGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGGKPGR

SEQ ID NO: 336 - protein, 163 aa, Artificial Sequence
  Description of Artificial Sequence: Synthetic polypeptide
AEATTAAGGAEEEGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGGKPGR

SEQ ID NO: 337 - protein, 595 aa, Artificial Sequence; identical to SEQ ID NO: 333
  Description of Artificial Sequence: Synthetic polypeptide

SEQ ID NO: 338 - protein, 451 aa, Artificial Sequence; identical to SEQ ID NO: 334
  Description of Artificial Sequence: Synthetic polypeptide

SEQ ID NO: 339 - protein, 307 aa, Artificial Sequence; identical to SEQ ID NO: 335
  Description of Artificial Sequence: Synthetic polypeptide

SEQ ID NO: 340 - protein, 163 aa, Artificial Sequence; identical to SEQ ID NO: 336
  Description of Artificial Sequence: Synthetic polypeptide

SEQ ID NO: 341 - protein, 734 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSCTSPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 342 - protein, 1071 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGASASCAPSTGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPG

SEQ ID NO: 343 - protein, 878 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGGSPAGSCTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 344 - protein, 927 aa, Artificial Sequence
  Description of Artificial Sequence: Synthetic polypeptide
MAEPAGSPTSTEEGTPGSGTASSSPGSSTPSGATGSPGASPGTSSTGSPGGPEPTCPAPSGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 345 - protein, 891 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGGSPAGSCTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGGSPAGSCTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 346 - protein, 796 aa, Artificial Sequence
  Description of Artificial Sequence: Synthetic polypeptide
MAEPAGSPTSTEEGTPGSGTASSSPGSSTPSGATGSPGASPGTSSTGSPGGASASCAPSTGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGASASCAPSTGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPG

SEQ ID NO: 347 - protein, 938 aa, Artificial Sequence
  Description of Artificial Sequence: Synthetic polypeptide
MAEPAGSPTSTEEGASPGTSSTGSPGSSTPSGATGSPGSSTPSGATGSPGGGSPAGSCTSPGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 348 - protein, 1381 aa, Artificial Sequence
  Description of Artificial Sequence: Synthetic polypeptide
MAEPAGSPTSTEEGASPGTSSTGSPGSSTPSGATGSPGSSTPSGATGSPGGASASCAPSTGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPG

SEQ ID NO: 349 - protein, 938 aa, Artificial Sequence
  Description of Artificial Sequence: Synthetic polypeptide
MAEPAGSPTSTEEGASPGTSSTGSPGSSTPSGATGSPGSSTPSGATGSPGGPEPTCPAPSGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 350 - protein, 1000 aa, Artificial Sequence
  Description of Artificial Sequence: Synthetic polypeptide
MAEPAGSPTSTEEGASPGTSSTGSPGSSTPSGATGSPGSSTPSGATGSPGGPEPTCPAPSGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGGPEPTCPAPSGGMAEPAGSPTSTEEGASPGTSSTGSPGSSTPSGATGSPGSSTPSGATGSPG

SEQ ID NO: 351 - protein, 734 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSKTSPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 352 - protein, 1071 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGASASKAPSTGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPG

SEQ ID NO: 353 - protein, 878 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGGSPAGSKTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 354 - protein, 927 aa, Artificial Sequence
  Description of Artificial Sequence: Synthetic polypeptide
MAEPAGSPTSTEEGTPGSGTASSSPGSSTPSGATGSPGASPGTSSTGSPGGASASKAPSTGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 355 - protein, 891 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGGSPAGSKTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGGSPAGSKTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 356 - protein, 796 aa, Artificial Sequence
  Description of Artificial Sequence: Synthetic polypeptide
MAEPAGSPTSTEEGTPGSGTASSSPGSSTPSGATGSPGASPGTSSTGSPGGGSPAGSKTSPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGGSPAGSKTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPG

SEQ ID NO: 357 - protein, 938 aa, Artificial Sequence
  Description of Artificial Sequence: Synthetic polypeptide
MAEPAGSPTSTEEGASPGTSSTGSPGSSTPSGATGSPGSSTPSGATGSPGGGSPAGSKTSPGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 358 - protein, 1381 aa, Artificial Sequence
  Description of Artificial Sequence: Synthetic polypeptide
MAEPAGSPTSTEEGASPGTSSTGSPGSSTPSGATGSPGSSTPSGATGSPGGASASKAPSTGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPG

SEQ ID NO: 359 - protein, 938 aa, Artificial Sequence
  Description of Artificial Sequence: Synthetic polypeptide
MAEPAGSPTSTEEGASPGTSSTGSPGSSTPSGATGSPGSSTPSGATGSPGGASASKAPSTGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 360 - protein, 1000 aa, Artificial Sequence
  Description of Artificial Sequence: Synthetic polypeptide
MAEPAGSPTSTEEGASPGTSSTGSPGSSTPSGATGSPGSSTPSGATGSPGGASASKAPSTGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGGASASKAPSTGGMAEPAGSPTSTEEGASPGTSSTGSPGSSTPSGATGSPGSSTPSGATGSPG

SEQ ID NO: 361 - protein, 891 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGGSPAGSCTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGGSPAGSKTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 362 - protein, 677 aa, Artificial Sequence
  Description of Artificial Sequence: Synthetic polypeptide
MAEPAGSPTSTEEGTPGSGTASSSPGSSTPSGATGSPGASPGTSSTGSPGGGSPAGSCTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSCTSPGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSCTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSCTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPG

SEQ ID NO: 363 - protein, 677 aa, Artificial Sequence
  Description of Artificial Sequence: Synthetic polypeptide
MAEPAGSPTSTEEGTPGSGTASSSPGSSTPSGATGSPGASPGTSSTGSPGGGSPAGSKTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSKTSPGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSKTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSKTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPG

SEQ ID NO: 364 - protein, 432 aa, Artificial Sequence
  Description of Artificial Sequence: Synthetic polypeptide
SAGSPTAEAAGCGTAEAAGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPTAEAAGCGTAEAAGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPTAEAAGCGTAEAASASR

SEQ ID NO: 365 - protein, 864 aa, Artificial Sequence
  Description of Artificial Sequence: Synthetic polypeptide
SAGSPGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAGPTKPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPTKPGTSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPTAEAAGCGTAEAAGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPTAEAAGCGTAEAASASR

SEQ ID NO: 366 - protein, 912 aa, Artificial Sequence
  Description of Artificial Sequence: Synthetic polypeptide
SAGSPTAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAASASR

SEQ ID NO: 367 - protein, 864 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAPGSEPATSGSETPGTSESATPESGPGSEPATSGSETPGTAEAAGCGTAEAASTEPSEGSAPGTSESATPESGPGSPAGSPTSTEEGSPATAEAAGCGTAEAASPTSTEEGTSESATPESGPGTSTEPSEGSAPGTSESATTAEAAGCGTAEAASETPGTSESATPESGPGSEPATSGSETPGTSESATPESGTAEAAGCGTAEAAGSPAGSPTSTEEGTSESATPESGPGSEPATSGSETPGTTAEAAGCGTAEAAAGSPTSTEEGSPAGSPTSTEEGTSTEPSEGSAPGTSESTAEAAGCGTAEAATPESGPGTSESATPESGPGSEPATSGSETPGSEPATSGTAEAAGCGTAEAATEEGTSTEPSEGSAPGTSTEPSEGSAPGSEPATSGSETPTAEAAGCGTAEAASASR

SEQ ID NO: 368 - protein, 432 aa, Artificial Sequence; identical to SEQ ID NO: 364
  Description of Artificial Sequence: Synthetic polypeptide

SEQ ID NO: 369 - protein, 432 aa, Artificial Sequence
  Description of Artificial Sequence: Synthetic polypeptide
SAGSPTAEAAGCGTAEAAPGSEPATSGSETPGTSESATPESGPGSEPATSGSETPGTAEAAGCGTAEAASTEPSEGSAPGTSESATPESGPGSPAGSPTSTEEGSPATAEAAGCGTAEAASPTSTEEGTSESATPESGPGTSTEPSEGSAPGTSESATTAEAAGCGTAEAASETPGTSESATPESGPGSEPATSGSETPGTSESATPESGTAEAAGCGTAEAAGSPAGSPTSTEEGTSESATPESGPGSEPATSGSETPGTTAEAAGCGTAEAAAGSPTSTEEGSPAGSPTSTEEGTSTEPSEGSAPGTSESTAEAAGCGTAEAATPESGPGTSESATPESGPGSEPATSGSETPGSEPATSGTAEAAGCGTAEAATEEGTSTEPSEGSAPGTSTEPSEGSAPGSEPATSGSETPTAEAAGCGTAEAASASR

SEQ ID NO: 370 - protein, 288 aa, Artificial Sequence; identical to SEQ ID NO: 181
  Description of Artificial Sequence: Synthetic polypeptide

SEQ ID NO: 371 - protein, 869 aa, Artificial Sequence; identical to SEQ ID NO: 179
  Description of Artificial Sequence: Synthetic polypeptide

SEQ ID NO: 372 - protein, 883 aa, Artificial Sequence
  Description of Artificial Sequence: Synthetic polypeptide
GSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGKPGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGK

SEQ ID NO: 373 - protein, 886 aa, Artificial Sequence
  Description of Artificial Sequence: Synthetic polypeptide
SAGSPTAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 374 - protein, 870 aa, Artificial Sequence
  Description of Artificial Sequence: Synthetic polypeptide
CGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGR

SEQ ID NO: 375 - protein, 342 aa, Artificial Sequence
  Description of Artificial Sequence: Synthetic polypeptide
MKNPEQAEEQAEEQREETRPRPRPRPRPRPRPRPRPRPRPSASRSAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASRSAHHHHHHHH

SEQ ID NO: 376 - protein, 486 aa, Artificial Sequence
  Description of Artificial Sequence: Synthetic polypeptide
MKNPEQAEEQAEEQREETRPRPRPRPRPRPRPRPRPRPRPSASRSAGSPTAEAAGCGTAEAAPGSEPATSGSETPGTSESATPESGPGSEPATSGSETPGTAEAAGCGTAEAASTEPSEGSAPGTSESATPESGPGSPAGSPTSTEEGSPATAEAAGCGTAEAASPTSTEEGTSESATPESGPGTSTEPSEGSAPGTSESATTAEAAGCGTAEAASETPGTSESATPESGPGSEPATSGSETPGTSESATPESGTAEAAGCGTAEAAGSPAGSPTSTEEGTSESATPESGPGSEPATSGSETPGTTAEAAGCGTAEAAAGSPTSTEEGSPAGSPTSTEEGTSTEPSEGSAPGTSESTAEAAGCGTAEAATPESGPGTSESATPESGPGSEPATSGSETPGSEPATSGTAEAAGCGTAEAATEEGTSTEPSEGSAPGTSTEPSEGSAPGSEPATSGSETPTAEAAGCGTAEAASASRSAHHHHHHHH

SEQ ID NO: 377 - protein, 918 aa, Artificial Sequence
  Description of Artificial Sequence: Synthetic polypeptide
MKNPEQAEEQAEEQREETRPRPRPRPRPRPRPRPRPRPRPSASRSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAPGSEPATSGSETPGTSESATPESGPGSEPATSGSETPGTAEAAGCGTAEAASTEPSEGSAPGTSESATPESGPGSPAGSPTSTEEGSPATAEAAGCGTAEAASPTSTEEGTSESATPESGPGTSTEPSEGSAPGTSESATTAEAAGCGTAEAASETPGTSESATPESGPGSEPATSGSETPGTSESATPESGTAEAAGCGTAEAAGSPAGSPTSTEEGTSESATPESGPGSEPATSGSETPGTTAEAAGCGTAEAAAGSPTSTEEGSPAGSPTSTEEGTSTEPSEGSAPGTSESTAEAAGCGTAEAATPESGPGTSESATPESGPGSEPATSGSETPGSEPATSGTAEAAGCGTAEAATEEGTSTEPSEGSAPGTSTEPSEGSAPGSEPATSGSETPTAEAAGCGTAEAASASRSAHHHHHHHH

SEQ ID NO: 378 - protein, 883 aa, Artificial Sequence; identical to SEQ ID NO: 372
  Description of Artificial Sequence: Synthetic polypeptide

SEQ ID NO: 379 - protein, 886 aa, Artificial Sequence; identical to SEQ ID NO: 373
  Description of Artificial Sequence: Synthetic polypeptide

SEQ ID NO: 380 - protein, 144 aa, Artificial Sequence
  Description of Artificial Sequence: Synthetic polypeptide
SAGSPTEGTSTEPSEGSAPGTSESTAEAAGCGTAEAATPESGPGTSESATPESGPGSEPATSGSETPGSEPATSGTAEAAGCGTAEAATEEGTSTEPSEGSAPGTSTEPSEGSAPGSEPATSGSETPTAEAAGCGTAEAASASR

SEQ ID NO: 381 - protein, 432 aa, Artificial Sequence
  Description of Artificial Sequence: Synthetic polypeptide
SAGSPTPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPTAEAAGCGTAEAASASR

SEQ ID NO: 382 - protein, 432 aa, Artificial Sequence
  Description of Artificial Sequence: Synthetic polypeptide
SAGSPTGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPTAEAAGCGTAEAAGSPAGSPTSTEEGTSESATPESGPGSEPATSGSETPGTSESATPESGPGSPAGSPTSTEEGSPAGSPTSTEEGTSTEPSEGSAPGTSESTAEAAGCGTAEAATPESGPGTSESATPESGPGSEPATSGSETPGSEPATSGSETPGSPAGSPTSTEEGTSTEPSEGSAPGTSTEPSEGSAPGSEPATSGSETPTAEAAGCGTAEAASASR

SEQ ID NO: 383 - protein, 432 aa, Artificial Sequence
  Description of Artificial Sequence: Synthetic polypeptide
SAGSPTPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESTAEAAGCGTAEAATPESGPGTSESATPESGPGSEPATSGSETPGSEPATSGTAEAAGCGTAEAATEEGTSTEPSEGSAPGTSTEPSEGSAPGSEPATSGSETPTAEAAGCGTAEAASASR

SEQ ID NO: 384 - protein, 144 aa, Artificial Sequence
  Description of Artificial Sequence: Synthetic polypeptide
SAGSPGSTSSTAESPGPGSTSSTAESPGPGCTSESPSGTAPGSTSSTAESPGPGSTSSTAESPGPGTSTPESGSASPGSTSCSPSGEAPGTSPSGESSTAPGSTSESPSGTAPGSTSESPSGTAPETSPSGESCTAPGSTSASR

SEQ ID NO: 385 - protein, 144 aa, Artificial Sequence
  Description of Artificial Sequence: Synthetic polypeptide
SAGSPGTPGSGTASSSPGSSTPSGATGSPGCAGSGTASSSPGSSTPSGATGSPGTPGSGTASSSPGSSTPSGATGSPGSSTCSGATGSPGSSPSASTGTGPGSSPSASTGTGPGASPGTSSTGSPGTPGSGTACSSPGSSSASR

SEQ ID NO: 386 - protein, 864 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASK

SEQ ID NO: 387 - protein, 288 aa, Artificial Sequence
  Description of Artificial Sequence: Synthetic polypeptide
SAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTACSEGSAPSASR

SEQ ID NO: 388 - protein, 288 aa, Artificial Sequence
  Description of Artificial Sequence: Synthetic polypeptide
SAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSCASASR

SEQ ID NO: 389 - protein, 144 aa, Artificial Sequence
  Description of Artificial Sequence: Synthetic polypeptide
SAGSPGSCAGSPTSTEEGTSESACPESGPGTSTEPSEGSCPGSPAGSPTSTEEGTCTEPSEGSAPGTSTEPCSGSAPGTSESATPESCPGSEPATSGSETPGSCPATSGSETPGSPAGSCTSTEEGTSESATPESCPGTESASR

SEQ ID NO: 390 - protein, 288 aa, Artificial Sequence
  Description of Artificial Sequence: Synthetic polypeptide
SAGSPTGCGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSCTPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSCGSAPSASR

SEQ ID NO: 391 - protein, 288 aa, Artificial Sequence
  Description of Artificial Sequence: Synthetic polypeptide
SAGSPTGCGSEPATSGSETPGTSESATPESGPGSEPATSGSCTPGTSESATPESGPGTSTEPSEGSAPGSPAGSPCSTEEGTSESATPESGPGSEPATSGSETPGTSESCTPESGPGSPAGSPTSTEEGSPAGSPTSTEEGTSCTPSEGSAPGTSESATPESGPGTSESATPESGPGCSESATPESGPGSEPATSGSETPGSEPATSGSETCGSPAGSPTSTEEGTSTEPSEGSAPGTSTEPSEGCAPGSEPATSGSETPGTSESATPESGPGTSTEPSCGSAPSASR

SEQ ID NO: 392 - protein, 12 aa, Artificial Sequence
  Description of Artificial Sequence: Synthetic peptide
GGSPAGSKPTSP

SEQ ID NO: 393 - protein, 12 aa, Artificial Sequence
  Description of Artificial Sequence: Synthetic peptide
GASASKPAPSTG

SEQ ID NO: 394 - protein, 5 aa, Artificial Sequence
  Description of Artificial Sequence: Synthetic peptide
PPKPP

SEQ ID NO: 395 - protein, 5 aa, Artificial Sequence
  Description of Artificial Sequence: Synthetic peptide
GGKPG

SEQ ID NO: 396 - protein, 8 aa, Artificial Sequence
  Description of Artificial Sequence: Synthetic peptide
EGGKPGES

SEQ ID NO: 397 - protein, 14 aa, Artificial Sequence
  Description of Artificial Sequence: Synthetic peptide
EGGSPAGSKPTSPE

SEQ ID NO: 398 - protein, 14 aa, Artificial Sequence
  Description of Artificial Sequence: Synthetic peptide
EGASASKPAPSTGE

SEQ ID NO: 399 - protein, 11 aa, Artificial Sequence
  Description of Artificial Sequence: Synthetic peptide
GGSPAGSCTSP

SEQ ID NO: 400 - protein, 11 aa, Artificial Sequence
  Description of Artificial Sequence: Synthetic peptide
GASASCAPSTG

SEQ ID NO: 401 - protein, 11 aa, Artificial Sequence
  Description of Artificial Sequence: Synthetic peptide
GPEPTCPAPSG

SEQ ID NO: 402 - protein, 13 aa, Artificial Sequence
  Description of Artificial Sequence: Synthetic peptide
TAEAAGCGTAEAA

SEQ ID NO: 403 - protein, 5 aa, Artificial Sequence
  Description of Artificial Sequence: Synthetic peptide
GECEP

SEQ ID NO: 404 - protein, 6 aa, Artificial Sequence
  Description of Artificial Sequence: Synthetic peptide
GRPCRP

SEQ ID NO: 405 - protein, 15 aa, Artificial Sequence
  Description of Artificial Sequence: Synthetic peptide
GETSPAGSCTSPTET

SEQ ID NO: 406 - protein, 12 aa, Artificial Sequence
  Description of Artificial Sequence: Synthetic peptide
TESGRPCRPSET

SEQ ID NO: 407 - protein, 12 aa, Artificial Sequence
  Description of Artificial Sequence: Synthetic peptide
GPEPTCPAPSEG

SEQ ID NO: 408 - protein, 864 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTESASRSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTESASR

SEQ ID NO: 409 - protein, 864 aa, Artificial Sequence
  Description of Artificial Sequence: Synthetic polypeptide
SAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASRSAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASRSAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 410 - protein, 864 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASRSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASRSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASRSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASRSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASRSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASR

SEQ ID NO: 411 - protein, 864 aa, Artificial Sequence
  Description of Artificial Sequence: Synthetic polypeptide
SAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTACSEGSAPSASRSAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTACSEGSAPSASRSAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTACSEGSAPSASR

SEQ ID NO: 412 - protein, 864 aa, Artificial Sequence
  Description of Artificial Sequence: Synthetic polypeptide
SAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSCASASRSAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSCASASRSAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSCASASR

SEQ ID NO: 413 - protein, 7 aa, Artificial Sequence
  Description of Artificial Sequence: Synthetic peptide
LYPYPYP

SEQ ID NO: 414 - protein, 6 aa, Artificial Sequence
  Description of Artificial Sequence: Synthetic peptide
LYYYPP

SEQ ID NO: 415 - protein, 4 aa, Artificial Sequence
  Description of Artificial Sequence: Synthetic peptide
WPWP

SEQ ID NO: 416 - protein, 6 aa, Artificial Sequence
  Description of Artificial Sequence: Synthetic peptide
FPFPFP

SEQ ID NO: 417 - protein, 20 aa, Artificial Sequence
  Description of Artificial Sequence: Synthetic peptide
  misc_feature (1)..(20): This sequence may encompass 3-20 residues
YYYYYYYYYYYYYYYYYYYY

SEQ ID NO: 418 - protein, 20 aa, Artificial Sequence
  Description of Artificial Sequence: Synthetic peptide
  misc_feature (1)..(20): This sequence may encompass 3-20 residues
WWWWWWWWWWWWWWWWWWWW

SEQ ID NO: 419 - protein, 40 aa, Artificial Sequence
  Description of Artificial Sequence: Synthetic polypeptide
  misc_feature (1)..(40): This sequence may encompass 3-20 "Tyr Pro" repeating units
YPYPYPYPYPYPYPYPYPYPYPYPYPYPYPYPYPYPYPYP

SEQ ID NO: 420 - protein, 40 aa, Artificial Sequence
  Description of Artificial Sequence: Synthetic polypeptide
  misc_feature (1)..(40): This sequence may encompass 3-20 repeating "Trp Pro" repeating units
WPWPWPWPWPWPWPWPWPWPWPWPWPWPWPWPWPWPWPWP

SEQ ID NO: 421 - protein, 40 aa, Artificial Sequence
  Description of Artificial Sequence: Synthetic polypeptide
  misc_feature (1)..(40): This sequence may encompass 3-20 repeating "Phe Pro" repeating units
FPFPFPFPFPFPFPFPFPFPFPFPFPFPFPFPFPFPFPFP

SEQ ID NO: 422 - protein, 40 aa, Artificial Sequence
  Description of Artificial Sequence: Synthetic polypeptide
  misc_feature (1)..(40): This sequence may encompass 3-20 repeating "Leu Pro" repeating units
LPLPLPLPLPLPLPLPLPLPLPLPLPLPLPLPLPLPLPLP

SEQ ID NO: 423 - protein, 40 aa, Artificial Sequence
  Description of Artificial Sequence: Synthetic polypeptide
  misc_feature (1)..(40): This sequence may encompass 3-20 repeating "Arg Pro" repeating units
RPRPRPRPRPRPRPRPRPRPRPRPRPRPRPRPRPRPRPRP

SEQ ID NO: 424 - protein, 40 aa, Artificial Sequence
  Description of Artificial Sequence: Synthetic polypeptide
  misc_feature (1)..(40): This sequence may encompass 3-20 repeating "Lys Pro" repeating units
KPKPKPKPKPKPKPKPKPKPKPKPKPKPKPKPKPKPKPKP

SEQ ID NO: 425 - protein, 40 aa, Artificial Sequence
  Description of Artificial Sequence: Synthetic polypeptide
  misc_feature (1)..(40): This sequence may encompass 3-20 repeating "His Pro" repeating units
HPHPHPHPHPHPHPHPHPHPHPHPHPHPHPHPHPHPHPHP

SEQ ID NO: 426 - protein, 20 aa, Artificial Sequence
  Description of Artificial Sequence: Synthetic peptide
  misc_feature (1)..(20): This sequence may encompass 3-20 residues
HHHHHHHHHHHHHHHHHHHH

SEQ ID NO: 427 - protein, 20 aa, Artificial Sequence
  Description of Artificial Sequence: Synthetic peptide
  misc_feature (1)..(20): This sequence may encompass 3-20 residues
RRRRRRRRRRRRRRRRRRRR

SEQ ID NO: 428 - protein, 20 aa, Artificial Sequence
  Description of Artificial Sequence: Synthetic peptide
  misc_feature (1)..(20): This sequence may encompass 3-20 residues
EEEEEEEEEEEEEEEEEEEE

SEQ ID NO: 429 - protein, 20 aa, Artificial Sequence
  Description of Artificial Sequence: Synthetic peptide
  misc_feature (1)..(20): This sequence may encompass 3-20 residues
DDDDDDDDDDDDDDDDDDDD

SEQ ID NO: 430 - protein, 40 aa, Artificial Sequence
  Description of Artificial Sequence: Synthetic polypeptide
  misc_feature (1)..(40): This sequence may encompass 3-20 "Glu Asp" repeating units
EDEDEDEDEDEDEDEDEDEDEDEDEDEDEDEDEDEDEDED

SEQ ID NO: 431 - protein, 40 aa, Artificial Sequence
  Description of Artificial Sequence: Synthetic polypeptide
  misc_feature (1)..(40): This sequence may encompass 3-20 "Glu Pro" repeating units
EPEPEPEPEPEPEPEPEPEPEPEPEPEPEPEPEPEPEPEP

SEQ ID NO: 432 - protein, 40 aa, Artificial Sequence
  Description of Artificial Sequence: Synthetic polypeptide
  misc_feature (1)..(40): This sequence may encompass 3-20 "Asp Pro" repeating units
DPDPDPDPDPDPDPDPDPDPDPDPDPDPDPDPDPDPDPDP

SEQ ID NO: 433 - protein, 10 aa, Artificial Sequence
  Description of Artificial Sequence: Synthetic peptide
RPRPRPRPRP

SEQ ID NO: 434 - protein, 12 aa, Artificial Sequence
  Description of Artificial Sequence: Synthetic peptide
RPRPRPRPRPGR

SEQ ID NO: 435 - protein, 14 aa, Artificial Sequence
  Description of Artificial Sequence: Synthetic peptide
RPRPRPRPRPRPRP

SEQ ID NO: 436 - protein, 16 aa, Artificial Sequence
  Description of Artificial Sequence: Synthetic peptide
RPRPRPRPRPRPRPGR

SEQ ID NO: 437 - protein, 10 aa, Artificial Sequence
  Description of Artificial Sequence: Synthetic peptide
KPKPKPKPKP

SEQ ID NO: 438 - protein, 12 aa, Artificial Sequence
  Description of Artificial Sequence: Synthetic peptide
KPKPKPKPKPGR

SEQ ID NO: 439 - protein, 18 aa, Artificial Sequence
  Description of Artificial Sequence: Synthetic peptide
RPRPRPRPRPRPRPRPRP

SEQ ID NO: 440 - protein, 20 aa, Artificial Sequence
  Description of Artificial Sequence: Synthetic peptide
RPRPRPRPRPRPRPRPRPGR

SEQ ID NO: 441 - protein, 22 aa, Artificial Sequence
  Description of Artificial Sequence: Synthetic peptide
RPRPRPRPRPRPRPRPRPRPRP

SEQ ID NO: 442 - protein, 24 aa, Artificial Sequence
  Description of Artificial Sequence: Synthetic peptide
RPRPRPRPRPRPRPRPRPRPRPGR

SEQ ID NO: 443 - protein, 28 aa, Artificial Sequence
  Description of Artificial Sequence: Synthetic peptide
RPRPRPRPRPRPRPRPRPRPRPRPRPRP

SEQ ID NO: 444 - protein, 18 aa, Artificial Sequence
  Description of Artificial Sequence: Synthetic peptide
RPRPKPRPKPRPKPRPKP

SEQ ID NO: 445 - protein, 19 aa, Artificial Sequence
  Description of Artificial Sequence: Synthetic peptide
PRPKPRPKPRPKPRPKPGR

SEQ ID NO: 446 - protein, 22 aa, Artificial Sequence
  Description of Artificial Sequence: Synthetic peptide
RPRPKPRPKPRPKPRPKPRPKP

SEQ ID NO: 447 - protein, 24 aa, Artificial Sequence
  Description of Artificial Sequence: Synthetic peptide
RPRPKPRPKPRPKPRPKPRPKPGR

SEQ ID NO: 448 - protein, 11 aa, Artificial Sequence
  Description of Artificial Sequence: Synthetic peptide
GSPYGYPYSYS

SEQ ID NO: 449 - protein, 11 aa, Artificial Sequence
  Description of Artificial Sequence: Synthetic peptide
GSPWGSPTSTE

SEQ ID NO: 450 - protein, 11 aa, Artificial Sequence
  Description of Artificial Sequence: Synthetic peptide
GSPAGSPTSTE

SEQ ID NO: 451 - protein, 11 aa, Artificial Sequence
  Description of Artificial Sequence: Synthetic peptide
  MOD_RES (4)..(4): Ile, Leu, Val, Phe, Trp or Tyr
  MOD_RES (6)..(6): Ile, Leu, Val, Phe, Trp or Tyr
  MOD_RES (8)..(8): Ile, Leu, Val, Phe, Trp or Tyr
  MOD_RES (10)..(10): Ile, Leu, Val, Phe, Trp or Tyr
GSPXGXPXSXS

SEQ ID NO: 452 - protein, 11 aa, Artificial Sequence
  Description of Artificial Sequence: Synthetic peptide
  MOD_RES (6)..(6): Ile, Leu, Val, Phe, Trp or Tyr
  MOD_RES (8)..(8): Ile, Leu, Val, Phe, Trp or Tyr
  MOD_RES (10)..(10): Ile, Leu, Val, Phe, Trp or Tyr
GSPSGXPXSXS

SEQ ID NO: 453 - protein, 11 aa, Artificial Sequence
  Description of Artificial Sequence: Synthetic peptide
  MOD_RES (8)..(8): Ile, Leu, Val, Phe, Trp or Tyr
  MOD_RES (10)..(10): Ile, Leu, Val, Phe, Trp or Tyr
GSPSGTPXSXS

SEQ ID NO: 454 - protein, 11 aa, Artificial Sequence
  Description of Artificial Sequence: Synthetic peptide
  MOD_RES (4)..(4): Arg, Lys or His
  MOD_RES (6)..(6): Arg, Lys or His
  MOD_RES (8)..(8): Arg, Lys or His
  MOD_RES (10)..(10): Arg, Lys or His
GSPXGXPXSXS

SEQ ID NO: 455 - protein, 11 aa, Artificial Sequence
  Description of Artificial Sequence: Synthetic peptide
  MOD_RES (6)..(6): Arg, Lys or His
  MOD_RES (8)..(8): Arg, Lys or His
  MOD_RES (10)..(10): Arg, Lys or His
GSPSGXPXSXS

SEQ ID NO: 456 - protein, 11 aa, Artificial Sequence
  Description of Artificial Sequence: Synthetic peptide
  MOD_RES (8)..(8): Arg, Lys or His
  MOD_RES (10)..(10): Arg, Lys or His
GSPSGTPXSXS

SEQ ID NO: 457 - protein, 11 aa, Artificial Sequence
  Description of Artificial Sequence: Synthetic peptide
STRPSRRSRRG

SEQ ID NO: 458 - protein, 13 aa, Artificial Sequence
  Description of Artificial Sequence: Synthetic peptide
STRRGTRRGTRRG

SEQ ID NO: 459 - protein, 11 aa, Artificial Sequence
  Description of Artificial Sequence: Synthetic peptide
STRPSRGRARG

SEQ ID NO: 460 - protein, 10 aa, Artificial Sequence
  Description of Artificial Sequence: Synthetic peptide
STRPSRRARG

SEQ ID NO: 461 - protein, 10 aa, Artificial Sequence
  Description of Artificial Sequence: Synthetic peptide
STRPSRRRRG

SEQ ID NO: 462 - protein, 11 aa, Artificial Sequence
  Description of Artificial Sequence: Synthetic peptide
STEPSEESEEG

SEQ ID NO: 463 - protein, 13 aa, Artificial Sequence
  Description of Artificial Sequence: Synthetic peptide
STEEGTEEGTEEG

SEQ ID NO: 464 - protein, 11 aa, Artificial Sequence
  Description of Artificial Sequence: Synthetic peptide
STEPSEGEAEG

SEQ ID NO: 465 - protein, 10 aa, Artificial Sequence
  Description of Artificial Sequence: Synthetic peptide
STEPSEEAEG

SEQ ID NO: 466 - protein, 10 aa, Artificial Sequence
  Description of Artificial Sequence: Synthetic peptide
STEPSEEEEG

SEQ ID NO: 467 - protein, 6 aa, Artificial Sequence
  Description of Artificial Sequence: Synthetic peptide
SASRSA

SEQ ID NO: 468 - protein, 6 aa, Artificial Sequence
  Description of Artificial Sequence: Synthetic peptide
SASKSA

SEQ ID NO: 469 - protein, 6 aa, Artificial Sequence
  Description of Artificial Sequence: Synthetic peptide
GSGRAT

SEQ ID NO: 470 - protein, 6 aa, Artificial Sequence
  Description of Artificial Sequence: Synthetic peptide
EAARHH

SEQ ID NO: 471 - protein, 6 aa, Artificial Sequence
  Description of Artificial Sequence: Synthetic peptide
APGRHH

SEQ ID NO: 472 - protein, 6 aa, Artificial Sequence
  Description of Artificial Sequence: Synthetic peptide
GSGRGS

SEQ ID NO: 473 - protein, 7 aa, Artificial Sequence
  Description of Artificial Sequence: Synthetic peptide
KLTRAET

SEQ ID NO: 474 - protein, 7 aa, Artificial Sequence
  Description of Artificial Sequence: Synthetic peptide
DFTRVVG

SEQ ID NO: 475 - protein, 8 aa, Artificial Sequence
  Description of Artificial Sequence: Synthetic peptide
TMTRIVGG

SEQ ID NO: 476 - protein, 8 aa, Artificial Sequence
  Description of Artificial Sequence: Synthetic peptide
SPFRSTGG

SEQ ID NO: 477 - protein, 8 aa, Artificial Sequence
  Description of Artificial Sequence: Synthetic peptide
LQVRIVGG

SEQ ID NO: 478 - protein, 8 aa, Artificial Sequence
  Description of Artificial Sequence: Synthetic peptide
PLGRIVGG

SEQ ID NO: 479 - protein, 8 aa, Artificial Sequence
  Description of Artificial Sequence: Synthetic peptide
IEGRTVGG

SEQ ID NO: 480 - protein, 8 aa, Artificial Sequence
  Description of Artificial Sequence: Synthetic peptide
LTPRSLLV

SEQ ID NO: 481 - protein, 8 aa, Artificial Sequence
  Description of Artificial Sequence: Synthetic peptide
LGPVSGVP

SEQ ID NO: 482 - protein, 8 aa, Artificial Sequence
  Description of Artificial Sequence: Synthetic peptide
VAGDSLEE

SEQ ID NO: 483 - protein, 8 aa, Artificial Sequence
  Description of Artificial Sequence: Synthetic peptide
GPAGLGGA

SEQ ID NO: 484 - protein, 8 aa, Artificial Sequence
  Description of Artificial Sequence: Synthetic peptide
GPAGLRGA

SEQ ID NO: 485 - protein, 8 aa, Artificial Sequence
  Description of Artificial Sequence: Synthetic peptide
APLGLRLR

SEQ ID NO: 486 - protein, 8 aa, Artificial Sequence
  Description of Artificial Sequence: Synthetic peptide
PALPLVAQ

SEQ ID NO: 487 - protein, 7 aa, Artificial Sequence
  Description of Artificial Sequence: Synthetic peptide
ENLYFQG

SEQ ID NO: 488 - protein, 8 aa, Artificial Sequence
  Description of Artificial Sequence: Synthetic peptide
DDDKIVGG

SEQ ID NO: 489 - protein, 8 aa, Artificial Sequence
  Description of Artificial Sequence: Synthetic peptide
LEVLFQGP

SEQ ID NO: 490 - protein, 8 aa, Artificial Sequence
  Description of Artificial Sequence: Synthetic peptide
LPKTGSES

SEQ ID NO: 491 - protein, 8 aa, Artificial Sequence
  Description of Artificial Sequence: Synthetic peptide
  MOD_RES (2)..(2): Pro or Ala
  MOD_RES (3)..(3): Any amino acid
  MOD_RES (6)..(6): Any amino acid
  MOD_RES (8)..(8): Any amino acid
GXXGLXGX

SEQ ID NO: 492 - protein, 8 aa, Artificial Sequence
  Description of Artificial Sequence: Synthetic peptide
  MOD_RES (3)..(3): Any amino acid
  MOD_RES (6)..(6): Any amino acid
  MOD_RES (7)..(7): Gly or Ala
  MOD_RES (8)..(8): Any amino acid
GPXGLXXX

SEQ ID NO: 493 - protein, 8 aa, Artificial Sequence
  Description of Artificial Sequence: Synthetic peptide
ENLYFQGS

SEQ ID NO: 494 - protein, 8 aa, Artificial Sequence
  Description of Artificial Sequence: Synthetic peptide
  MOD_RES (3)..(3): Lys, Glu, Ala or Asp
  MOD_RES (6)..(6): Any amino acid
  MOD_RES (7)..(7): Glu, Lys or Ser
LPXTGXXS

SEQ ID NO: 495 - protein, 12 aa, Artificial Sequence
  Description of Artificial Sequence: Synthetic peptide
ADAQKAADNKKP

SEQ ID NO: 496 - protein, 12 aa, Artificial Sequence
  Description of Artificial Sequence: Synthetic peptide
KTLVYCSEGSPE

SEQ ID NO: 497 - protein, 12 aa, Artificial Sequence
  Description of Artificial Sequence: Synthetic peptide
ENNAQTTNESAG

SEQ ID NO: 498 - protein, 12 aa, Artificial Sequence
  Description of Artificial Sequence: Synthetic peptide
KDTIALVVSTLN

SEQ ID NO: 499 - protein, 11 aa, Artificial Sequence
  Description of Artificial Sequence: Synthetic peptide
APKDNTWYTGA

SEQ ID NO: 500 - protein, 12 aa, Artificial Sequence
  Description of Artificial Sequence: Synthetic peptide
ADVPAGVTLAEK

SEQ ID NO: 501 - protein, 12 aa, Artificial Sequence
  Description of Artificial Sequence: Synthetic peptide
KIEEGKLVIWIN

SEQ ID NO: 502 - protein, 10 aa, Artificial Sequence
  Description of Artificial Sequence: Synthetic peptide
AEATTAAGGA

SEQ ID NO: 503 - protein, 12 aa, Artificial Sequence
  Description of Artificial Sequence: Synthetic peptide
ATGTATSEGSPE

SEQ ID NO: 504 - protein, 12 aa, Artificial Sequence
  Description of Artificial Sequence: Synthetic peptide
EPTAATTGESAG

SEQ ID NO: 505 - protein, 10 aa, Artificial Sequence
  Description of Artificial Sequence: Synthetic peptide
AETTAPAGST

SEQ ID NO: 506 - protein, 11 aa, Artificial Sequence
  Description of Artificial Sequence: Synthetic peptide
APTEATAGTGA

SEQ ID NO: 507 - protein, 11 aa, Artificial Sequence
  Description of Artificial Sequence: Synthetic peptide
AETPAGATGAE

SEQ ID NO: 508 - protein, 10 aa, Artificial Sequence
  Description of Artificial Sequence: Synthetic peptide
APEEGTAGGA

SEQ ID NO: 509 - protein, 19 aa, Artificial Sequence
  Description of Artificial Sequence: Synthetic peptide
SLSTEATAKIVSEFGRDAN

SEQ ID NO: 510 - protein, 19 aa, Artificial Sequence
  Description of Artificial Sequence: Synthetic peptide
ANPEQLEEQREETRLIIEE

SEQ ID NO: 511 - protein, 19 aa, Artificial Sequence
  Description of Artificial Sequence: Synthetic peptide
SASTEATAKAASEAGRDAN

SEQ ID NO: 512 - protein, 14 aa, Artificial Sequence
  Description of Artificial Sequence: Synthetic peptide
ANPEQAEEQREETR

SEQ ID NO: 513 - protein, 13 aa, Artificial Sequence
  Description of Artificial Sequence: Synthetic peptide
ANPEQAEEQREET

SEQ ID NO: 514 - protein, 13 aa, Artificial Sequence
  Description of Artificial Sequence: Synthetic peptide
ANPEQAEEQSEET

SEQ ID NO: 515 - protein, 13 aa, Artificial Sequence
  Description of Artificial Sequence: Synthetic peptide
KNPEQAEEQREET

SEQ ID NO: 516 - protein, 13 aa, Artificial Sequence
  Description of Artificial Sequence: Synthetic peptide
KNPEQAEEQSEET

SEQ ID NO: 517 - protein, 17 aa, Artificial Sequence
  Description of Artificial Sequence: Synthetic peptide
KNPEQAEEQAEEQREET

SEQ ID NO: 518 - protein, 17 aa, Artificial Sequence
  Description of Artificial Sequence: Synthetic peptide
KNPEQAEEQAEEQSEET

SEQ ID NO: 519 - protein, 17 aa, Artificial Sequence
  Description of Artificial Sequence: Synthetic peptide
KNHEQAEEQAEEQSEET

SEQ ID NO: 520 - protein, 17 aa, Artificial Sequence
  Description of Artificial Sequence: Synthetic peptide
KKHEQAEEQAEEQSEET

SEQ ID NO: 521 - protein, 17 aa, Artificial Sequence
  Description of Artificial Sequence: Synthetic peptide
KKPEQAEEQAEEQREET

SEQ ID NO: 522 - protein, 17 aa, Artificial Sequence
  Description of Artificial Sequence: Synthetic peptide
KNHEQEKEKAEEQSEET

SEQ ID NO: 523 - protein, 17 aa, Artificial Sequence
  Description of Artificial Sequence: Synthetic peptide
KKQEQEEKKAEEQREET

SEQ ID NO: 524 - protein, 17 aa, Artificial Sequence
  Description of Artificial Sequence: Synthetic peptide
KNHEKDEKKAEEQSEET

SEQ ID NO: 525 - protein, 17 aa, Artificial Sequence
  Description of Artificial Sequence: Synthetic peptide
KKQEQEKEQAEEQREET

SEQ ID NO: 526 - protein, 17 aa, Artificial Sequence
  Description of Artificial Sequence: Synthetic peptide
KNPEQEKEKAEEQREET

SEQ ID NO: 527 - protein, 17 aa, Artificial Sequence
  Description of Artificial Sequence: Synthetic peptide
KKPEQEEKQAEEQREET

SEQ ID NO: 528 - protein, 21 aa, Artificial Sequence
  Description of Artificial Sequence: Synthetic peptide
KKQEQEKEQAEEQAESEREET

SEQ ID NO: 529 - protein, 21 aa, Artificial Sequence
  Description of Artificial Sequence: Synthetic peptide
KKQEQEKEQAEEQSQSQREET

SEQ ID NO: 530 - protein, 21 aa, Artificial Sequence
  Description of Artificial Sequence: Synthetic peptide
KKQEQEKEQAEEQSESEREET

SEQ ID NO: 531 - protein, 25 aa, Artificial Sequence
  Description of Artificial Sequence: Synthetic peptide
KKQEQEKEQAEEQAKAESEAEREET

SEQ ID NO: 532 - protein, 25 aa, Artificial Sequence
  Description of Artificial Sequence: Synthetic peptide
KKQEQEKEQAEEQSKSQAEAEREET

SEQ ID NO: 533 - protein, 25 aa, Artificial Sequence
  Description of Artificial Sequence: Synthetic peptide
KKQEQEKEQAEEQAQAQAEDEREET

SEQ ID NO: 534 - protein, 25 aa, Artificial Sequence
  Description of Artificial Sequence: Synthetic peptide
KKQEQEKEQAEEQSKSKAEDEREET

SEQ ID NO: 535 - protein, 21 aa, Artificial Sequence
  Description of Artificial Sequence: Synthetic peptide
KKQEQEKEQAEEQPEVQREET

SEQ ID NO: 536 - protein, 21 aa, Artificial Sequence
  Description of Artificial Sequence: Synthetic peptide
KKQEQEKEQAEEQVENPREET

SEQ ID NO: 537 - protein, 21 aa, Artificial Sequence
  Description of Artificial Sequence: Synthetic peptide
KKQEQEKEQAEEQELCEREET

SEQ ID NO: 538 - protein, 21 aa, Artificial Sequence
  Description of Artificial Sequence: Synthetic peptide
KKQEQEKEQAEEQGIDTREET

SEQ ID NO: 539 - protein, 22 aa, Homo sapiens
GLSKGCFGLKLDRIGSMSGLGC

SEQ ID NO: 540 - protein, 10 aa, Homo sapiens
  MOD_RES (1)..(1): pyroGlu
  C-term NH2
EHWSYGLRPG

SEQ ID NO: 541 - protein, 5 aa, Artificial Sequence
  Description of Artificial Sequence: Synthetic peptide
  MOD_RES (4)..(4): D-Phe
  MOD_RES (5)..(5): NmeVal
RGDFV

SEQ ID NO: 542 - protein, 44 aa, Unknown
  Description of Unknown: Growth hormone releasing factor polypeptide
YADAIFTNSYRKVLGQLSARKLLQDIMSRQQGESNQERGARARL

SEQ ID NO: 543 - protein, 29 aa, Unknown
  Description of Unknown: Growth hormone releasing factor peptide
YADAIFTNSYRKVLGQLSARKLLQDIMSR

SEQ ID NO: 544 - protein, 34 aa, Homo sapiens
  C-term NH2
IKPEAPGEDASPEELNRYYASLRHYLNLVTRQRY

SEQ ID NO: 545 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 546 - protein, 37 aa, Artificial Sequence
  Description of Artificial Sequence: Synthetic polypeptide
  C-term NH2
KCNTATCATNRLANFLVHSSNNFGPILPPTNVGSNTY

SEQ ID NO: 547 - protein, 9 aa, Homo sapiens
  misc_feature (1)..(6): Disulfide bridge
  C-term NH2
CYIQNCPLG

SEQ ID NO: 548 - protein, 29 aa, Homo sapiens
DSWMEEVIKLCGRELVRAQIAICGMSTWS

SEQ ID NO: 549 - protein, 24 aa, Homo sapiens
QLYSALANKCCHVGCTKRSLARFC

SEQ ID NO: 550 - protein, 37 aa, Artificial Sequence
  Description of Artificial Sequence: Synthetic polypeptide
GLSKGCFGLKLDRIGSMSGLGCPSLRDPRPNAPSTSA

SEQ ID NO: 551 - protein, 21 aa, Artificial Sequence
  Description of Artificial Sequence: Synthetic peptide
  MOD_RES (13)..(13): 1Nal
  MOD_RES (20)..(20): Sar
GGLYACHMGPITAVCQPLRXK

SEQ ID NO: 552 - protein, 37 aa, Homo sapiens
HSQGTFTSDYSKYLDSRRAQDFVQWLMNTKRNRNNIA

SEQ ID NO: 553 - protein, 13 aa, Artificial Sequence
  Description of Artificial Sequence: Synthetic peptide
  N-term H
  misc_feature (2)..(12): Cyclic
  C-term NH2
ICVVQDWGHHRCT

SEQ ID NO: 554 - protein, 181 aa, Homo sapiens
GPVPTSKPTTTGKGCHIGRFKSLSPQELASFKKARDALEESLKLKNWSCSSPVFPGNWDLRLLQVRERPVALEAELALTLKVLEAAAGPALEDVLDQPLHTLHHILSQLQACIQPQPTAGPRPRGRLHHWLHRLQEAPKKESAGCLEASVTFNLFRLLTRDLKYVADGNLCLRTSTHPEST

SEQ ID NO: 555 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 556 - protein, 31 aa, Homo sapiens
EAEDLQVGQVELGGGPGAGSLQPLALEGSLQ

SEQ ID NO: 557 - protein, 28 aa, Homo sapiens
GSSFLSPEHQRVQQRKESKKPPAKLQPR

SEQ ID NO: 558 - protein, 28 aa, Homo sapiens
  C-term NH2
HSDAVFTDNYTRLRKQMAVKKYLNSILN

SEQ ID NO: 559 - protein, 36 aa, Human immunodeficiency virus
YTSLIHSLIEESQNQQEKNEQELLELDKWASLWNWF

SEQ ID NO: 560 - protein, 112 aa, Unknown
  Description of Unknown: Irisin polypeptide
DSPSAPVNVTVRHLKANSAVVSWDVLEDEVVIGFAISQQKKDVRMLRFIQEVNTTTRSCALWDLEEDTEYIVHVQAISIQGQSPASEPVLFKTPREAEKMASKNKDEVTMKE

SEQ ID NO: 561 - protein, 7 aa, Artificial Sequence
  Description of Artificial Sequence: Synthetic peptide
NRVYIHP

SEQ ID NO: 562 - protein, 152 aa, Homo sapiens
DCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 563 - protein, 180 aa, Homo sapiens
EENVDFRIHVENQTRARDDVSRKQLRLYQLYSRTSGKHIQVLGRRISARGEDGDKYAQLLVETDTFGSQVRIKGKETEFYLCMNRKGKLVGKPDGTSKECVFIEKVLENNYTALMSAKYSGWYVGFTKKGRPRKGPKTRENQQDVHFMKRYPKGQPELQKPFKYTTVTKRSRRIRPTHPA

SEQ ID NO: 564 - protein, 12 aa, Artificial Sequence
  Description of Artificial Sequence: Synthetic peptide
  N-term N-Ac
SYSMGFRWGLPV

SEQ ID NO: 565 - protein, 183 aa, Homo sapiens
HSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 566 - protein, 24 aa, Homo sapiens
MAPRGFSCLLLLTSEIDLPVKRRA

SEQ ID NO: 567 - protein, 29 aa, Homo sapiens
HSQGTFTSDYSKYLDSRRAQDFVQWLMNT

SEQ ID NO: 568 - protein, 37 aa, Homo sapiens
HDEFERHAEGTFTSDVSSTLEGQAALEFIAWLVKGRG

SEQ ID NO: 569 - protein, 33 aa, Homo sapiens
HADGSFSDEMNTILDNLAARDFINWLIQTKITD

SEQ ID NO: 570 - protein, 33 aa, Artificial Sequence
  Description of Artificial Sequence: Synthetic polypeptide
HGDGSFSDEMNTILDNLAARDFINWLIQTKITD

SEQ ID NO: 571 - protein, 21 aa, Homo sapiens
GIVEQCCTSICSLYQLENYCN

SEQ ID NO: 572 - protein, 30 aa, Homo sapiens
FVNQHLCGSHLVEALYLVCGERGFFYTPKT

SEQ ID NO: 573 - protein, 731 aa, Homo sapiens
SETSRTAFGGRRAVPPNNSNAAEDDLPTVELQGVVPRGVNLQEFLNVTSVHLFKERWDTNKVDHHTDKYENNKLIVRRGQSFYVQIDFSRPYDPRRDLFRVEYVIGRYPQENKGTYIPVPIVSELQSGKWGAKIVMREDRSVRLSIQSSPKCIVGKFRMYVAVWTPYGVLRTSRNPETDTYILFNPWCEDDAVYLDNEKEREEYVLNDIGVIFYGEVNDIKTRSWSYGQFEDGILDTCLYVMDRAQMDLSGRGNPIKVSRVGSAMVNAKDDEGVLVGSWDNIYAYGVPPSAWTGSVDILLEYRSSENPVRYGQCWVFAGVFNTFLRCLGIPARIVTNYFSAHDNDANLQMDIFLEEDGNVNSKLTKDSVWNYHCWNEAWMTRPDLPVGFGGWQAVDSTPQENSDGMYRCGPASVQAIKHGHVCFQFDAPFVFAEVNSDLIYITAKKDGTHVVENVDATHIGKLIVTKQIGGDGMMDITDTYKFQEGQEEERLALETALMYGAKKPLNTEGVMKSRSNVDMDFEVENAVLGKDFKLSITFRNNSHNRYTITAYLSANITFYTGVPKAEFKKETFDVTLEPLSFKKEAVLIQAGEYMGQLLEQASLHFFVTARINETRDVLAKQKSTVLTIPEIIIKVRGTQVVGSDMTVTVQFTNPLKETLRNVWVHLDGPGVTRPMKKMFREIRPNSTVQWEEVCRPWVSGHRKLIASMSSDSLRHVYGELDVQIQRRPSM

SEQ ID NO: 574 - protein, 487 aa, Homo sapiens
GRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 575 - protein, 5 aa, Artificial Sequence
  Description of Artificial Sequence: Synthetic peptide
GQQQL

SEQ ID NO: 576 - protein, 5 aa, Artificial Sequence
  Description of Artificial Sequence: Synthetic peptide
LPETG

SEQ ID NO: 577 - protein, 6 aa, Artificial Sequence
  Description of Artificial Sequence: Synthetic peptide
LPETGG

SEQ ID NO: 578 - protein, 4 aa, Artificial Sequence
  Description of Artificial Sequence: Synthetic peptide
GFLG

SEQ ID NO: 579 - protein, 7 aa, Artificial Sequence
  Description of Artificial Sequence: Synthetic peptide
  N-term Epsilon-maleimidocaproyl
  C-term p-aminobenzyloxycarbonyl-paclitaxel
RSSYYSL

SEQ ID NO: 580 - protein, 6 aa, Artificial Sequence
  Description of Artificial Sequence: Synthetic peptide
GPEGPS

SEQ ID NO: 581 - protein, 5 aa, Unknown
  Description of Unknown: Exemplary targeting moiety peptide
CNGRC

SEQ ID NO: 582 - protein, 6 aa, Unknown
  Description of Unknown: Exemplary targeting moiety peptide
CNGRCG

SEQ ID NO: 583 - protein, 5 aa, Unknown
  Description of Unknown: Exemplary targeting moiety peptide
GNGRG

SEQ ID NO: 584 - protein, 5 aa, Unknown
  Description of Unknown: Exemplary targeting moiety peptide
KNGRE

SEQ ID NO: 585 - protein, 13 aa, Unknown
  Description of Unknown: Exemplary targeting moiety peptide
GNGRGGNGRGKGK

SEQ ID NO: 586 - protein, 9 aa, Unknown
  Description of Unknown: Exemplary targeting moiety peptide
CVLNGRMEC

SEQ ID NO: 587 - protein, 6 aa, Unknown
  Description of Unknown: Exemplary targeting moiety peptide
NGRAHA

SEQ ID NO: 588 - protein, 13 aa, Unknown
  Description of Unknown: Exemplary targeting moiety peptide
CNGRCVSGCAGRC

SEQ ID NO: 589 - protein, 9 aa, Unknown
  Description of Unknown: Exemplary targeting moiety peptide
CGNKRTRGC

SEQ ID NO: 590 - protein, 10 aa, Unknown
  Description of Unknown: Exemplary targeting moiety peptide
TAASGVRSMH

SEQ ID NO: 591 - protein, 10 aa, Unknown
  Description of Unknown: Exemplary targeting moiety peptide
LTLRWVGLMS

SEQ ID NO: 592 - protein, 9 aa, Unknown
  Description of Unknown: Exemplary targeting moiety peptide
CNRRTKAGC

SEQ ID NO: 593 - protein, 9 aa, Unknown
  Description of Unknown: Exemplary targeting moiety peptide
CLSDGKRKC

SEQ ID NO: 594 - protein, 9 aa, Unknown
  Description of Unknown: Exemplary targeting moiety peptide
CREAGRKAC

SEQ ID NO: 595 - protein, 9 aa, Unknown
  Description of Unknown: Exemplary targeting moiety peptide
CAGRRSAYC

SEQ ID NO: 596 - protein, 6 aa, Unknown
  Description of Unknown: Exemplary targeting moiety peptide
CRSRKG

SEQ ID NO: 597 - protein, 7 aa, Unknown
  Description of Unknown: Exemplary targeting moiety peptide
CKAAKNK

SEQ ID NO: 598 - protein, 9 aa, Unknown
  Description of Unknown: Exemplary targeting moiety peptide
CSRPRRSEC

SEQ ID NO: 599 - protein, 5 aa, Unknown
  Description of Unknown: Exemplary targeting moiety peptide
CGKRK

SEQ ID NO: 600 - protein, 5 aa, Unknown
  Description of Unknown: Exemplary targeting moiety peptide
CDTRL

SEQ ID NO: 601 - protein, 7 aa, Unknown
  Description of Unknown: Exemplary targeting moiety peptide
CGTKRKC

SEQ ID NO: 602 - protein, 10 aa, Artificial Sequence
  Description of Artificial Sequence: Synthetic peptide
  MOD_RES (1)..(1): pGlu
  C-term NH2
EHWSYGLRPG

SEQ ID NO: 603 - protein, 10 aa, Artificial Sequence
  Description of Artificial Sequence: Synthetic peptide
  MOD_RES (1)..(1): pGlu
  MOD_RES (6)..(6): D-Lys
  C-term NH2
EHWSYKLRPG

SEQ ID NO: 604 - protein, 10 aa, Artificial Sequence
  Description of Artificial Sequence: Synthetic peptide
  MOD_RES (1)..(1): pGlu
  MOD_RES (6)..(6): D-Trp
  C-term NH2
EHWSYWLRPG

SEQ ID NO: 605 - protein, 9 aa, Artificial Sequence
  Description of Artificial Sequence: Synthetic peptide
  MOD_RES (1)..(1): pGlu
  MOD_RES (6)..(6): D-Leu
  C-term NHEt
EHWSYLLRP

SEQ ID NO: 606 - protein, 9 aa, Artificial Sequence
  Description of Artificial Sequence: Synthetic peptide
  MOD_RES (1)..(1): pGlu
  MOD_RES (6)..(6): D-Ser(tBu)
  C-term NHEt
EHWSYSLRP

SEQ ID NO: 607 - protein, 10 aa, Artificial Sequence
  Description of Artificial Sequence: Synthetic peptide
  MOD_RES (1)..(1): pGlu
  MOD_RES (6)..(6): D-2-Nal
  C-term NH2
EHWSYALRPG

SEQ ID NO: 608 - protein, 9 aa, Artificial Sequence
  Description of Artificial Sequence: Synthetic peptide
  MOD_RES (1)..(1): pGlu
  MOD_RES (6)..(6): D-His(Bzl)
  C-term NHEt
EHWSYHLRP

SEQ ID NO: 609 - protein, 10 aa, Artificial Sequence
  Description of Artificial Sequence: Synthetic peptide
  MOD_RES (1)..(1): pGlu
  MOD_RES (6)..(6): D-Ser(tBu)
  MOD_RES (10)..(10): AzaGly
  C-term NH2
EHWSYSLRPG

SEQ ID NO: 610 - protein, 9 aa, Artificial Sequence
  Description of Artificial Sequence: Synthetic peptide
  MOD_RES (1)..(1): pGlu
  MOD_RES (6)..(6): D-Trp
  C-term NHEt
EHWSYWLRP

SEQ ID NO: 611 - protein, 10 aa, Artificial Sequence
  Description of Artificial Sequence: Synthetic peptide
  MOD_RES (1)..(1): pGlu
  C-term NH2
EHWSHDWLPG

SEQ ID NO: 612 - DNA, 36 bp, Artificial Sequence
  Description of Artificial Sequence: Synthetic oligonucleotide
aggtgaatctccdggtggytcyagcggttcygartc

SEQ ID NO: 613 - DNA, 36 bp, Artificial Sequence
  Description of Artificial Sequence: Synthetic oligonucleotide
acctgaytcrgaaccgctrgarccacchggagattc

SEQ ID NO: 614 - DNA, 36 bp, Artificial Sequence
  Description of Artificial Sequence: Synthetic oligonucleotide
aggtagcgaaggttcttcyggtccdggygartcytc

SEQ ID NO: 615 - DNA, 36 bp, Artificial Sequence
  Description of Artificial Sequence: Synthetic oligonucleotide
acctgargaytcrcchggaccrgaagaaccttcgct

SEQ ID NO: 616 - DNA, 36 bp, Artificial Sequence
  Description of Artificial Sequence: Synthetic oligonucleotide
aggttcytcygaaagcggttcttcygarggyggtcc

SEQ ID NO: 617 - DNA, 36 bp, Artificial Sequence
  Description of Artificial Sequence: Synthetic oligonucleotide
acctggaccrccytcrgaagaaccgctttcrgarga

SEQ ID NO: 618 - DNA, 36 bp, Artificial Sequence
  Description of Artificial Sequence: Synthetic oligonucleotide
aggttcyggtggygaaccdtcygartctggtagctc

SEQ ID NO: 619 - DNA, 24 bp, Artificial Sequence
  Description of Artificial Sequence: Synthetic oligonucleotide
aggttcgtcttcactcgagggtac

SEQ ID NO: 620 - DNA, 16 bp, Artificial Sequence
  Description of Artificial Sequence: Synthetic oligonucleotide
cctcgagtgaagacga

SEQ ID NO: 621 - protein, 36 aa, Artificial Sequence
  Description of Artificial Sequence: Synthetic polypeptide
GSGGEPSESGSSGESPGGSSGSESGESPGGSSGSES

SEQ ID NO: 622 - protein, 36 aa, Artificial Sequence
  Description of Artificial Sequence: Synthetic polypeptide
GSEGSSGPGESSGESPGGSSGSESGSSESGSSEGGP

SEQ ID NO: 623 - protein, 36 aa, Artificial Sequence
  Description of Artificial Sequence: Synthetic polypeptide
GSSESGSSEGGPGSSESGSSEGGPGESPGGSSGSES

SEQ ID NO: 624 - protein, 36 aa, Artificial Sequence
  Description of Artificial Sequence: Synthetic polypeptide
GSGGEPSESGSSGSSESGSSEGGPGSGGEPSESGSS

SEQ ID NO: 625 - protein, 36 aa, Artificial Sequence
  Description of Artificial Sequence: Synthetic polypeptide
GSSESGSSEGGPGSEGSSGPGESSGSEGSSGPGESS

SEQ ID NO: 626 - protein, 36 aa, Artificial Sequence
  Description of Artificial Sequence: Synthetic polypeptide
GSSESGSSEGGPGESPGGSSGSESGSEGSSGPGESS

SEQ ID NO: 627 - protein, 36 aa, Artificial Sequence
  Description of Artificial Sequence: Synthetic polypeptide
GSGGEPSESGSSGSGGEPSESGSSGSEGSSGPGESS

SEQ ID NO: 628 - protein, 36 aa, Artificial Sequence
  Description of Artificial Sequence: Synthetic polypeptide
GSSESGSSEGGPGSEGSSGPGESSGESPGGSSGSES

SEQ ID NO: 629 - protein, 36 aa, Artificial Sequence
  Description of Artificial Sequence: Synthetic polypeptide
GSSESGSSEGGPGSSESGSSEGGPGSSESGSSEGGP

SEQ ID NO: 630 - protein, 36 aa, Artificial Sequence
  Description of Artificial Sequence: Synthetic polypeptide
GSGGEPSESGSSGSEGSSGPGESSGSSESGSSEGGP

SEQ ID NO: 631 - protein, 36 aa, Artificial Sequence; identical to SEQ ID NO: 624
  Description of Artificial Sequence: Synthetic polypeptide

SEQ ID NO: 632 - protein, 36 aa, Artificial Sequence
  Description of Artificial Sequence: Synthetic polypeptide
GSGGEPSESGSSGSSESGSSEGGPGESPGGSSGSES

SEQ ID NO: 633 - protein, 36 aa, Artificial Sequence
  Description of Artificial Sequence: Synthetic polypeptide
GSGGEPSESGSSGESPGGSSGSESGSEGSSGPGESS

SEQ ID NO: 634 - protein, 36 aa, Artificial Sequence
  Description of Artificial Sequence: Synthetic polypeptide
GSGGEPSESGSSGESPGGSSGSESGSGGEPSESGSS

SEQ ID NO: 635 - protein, 36 aa, Artificial Sequence; identical to SEQ ID NO: 629
  Description of Artificial Sequence: Synthetic polypeptide

SEQ ID NO: 636 - protein, 36 aa, Artificial Sequence
  Description of Artificial Sequence: Synthetic polypeptide
GESPGGSSGSESGSEGSSGPGESSGSEGSSGPGESS

SEQ ID NO: 637 - protein, 36 aa, Artificial Sequence
  Description of Artificial Sequence: Synthetic polypeptide
GSGGEPSESGSSGSGGEPSESGSSGSSESGSSEGGP

SEQ ID NO: 638 - protein, 36 aa, Artificial Sequence
  Description of Artificial Sequence: Synthetic polypeptide
GSGGEPSESGSSGSGGEPSESGSSGSGGEPSESGSS

SEQ ID NO: 639 - protein, 36 aa, Artificial Sequence
  Description of Artificial Sequence: Synthetic polypeptide
GSGGEPSESGSSGSSESGSSEGGPGSEGSSGPGESS

SEQ ID NO: 640 - protein, 36 aa, Artificial Sequence
  Description of Artificial Sequence: Synthetic polypeptide
GSGGEPSESGSSGSEGSSGPGESSGSGGEPSESGSS

SEQ ID NO: 641 - protein, 36 aa, Artificial Sequence; identical to SEQ ID NO: 634
  Description of Artificial Sequence: Synthetic polypeptide

SEQ ID NO: 642 - protein, 36 aa, Artificial Sequence
  Description of Artificial Sequence: Synthetic polypeptide
GSSESGSSEGGPGSGGEPSESGSSGSSESGSSEGGP

SEQ ID NO: 643 - protein, 36 aa, Artificial Sequence
  Description of Artificial Sequence: Synthetic polypeptide
GSEGSSGPGESSGESPGGSSGSESGSEGSSGPGESS

SEQ ID NO: 644 - protein, 36 aa, Artificial Sequence; identical to SEQ ID NO: 629
  Description of Artificial Sequence: Synthetic polypeptide

SEQ ID NO: 645 - protein, 36 aa, Artificial Sequence; identical to SEQ ID NO: 621
  Description of Artificial Sequence: Synthetic polypeptide

SEQ ID NO: 646 - protein, 36 aa, Artificial Sequence
  Description of Artificial Sequence: Synthetic polypeptide
GSGGEPSESGSSGSEGSSGPGESSGESPGGSSGSES

SEQ ID NO: 647 - protein, 36 aa, Artificial Sequence
  Description of Artificial Sequence: Synthetic polypeptide
GESPGGSSGSESGESPGGSSGSESGESPGGSSGSES

SEQ ID NO: 648 - protein, 36 aa, Artificial Sequence
  Description of Artificial Sequence: Synthetic polypeptide
GSEGSSGPGESSGSEGSSGPGESSGSGGEPSESGSS

SEQ ID NO: 649 - protein, 36 aa, Artificial Sequence; identical to SEQ ID NO: 646
  Description of Artificial Sequence: Synthetic polypeptide

SEQ ID NO: 650 - protein, 36 aa, Artificial Sequence; identical to SEQ ID NO: 624
  Description of Artificial Sequence: Synthetic polypeptide

SEQ ID NO: 651 - protein, 36 aa, Artificial Sequence
  Description of Artificial Sequence: Synthetic polypeptide
GSSESGSSEGGPGSGGEPSESGSSGSEGSSGPGESS

SEQ ID NO: 652 - protein, 36 aa, Artificial Sequence
  Description of Artificial Sequence: Synthetic polypeptide
GSGGEPSESGSSGSEGSSGPGESSGSEGSSGPGESS

SEQ ID NO: 653 - protein, 36 aa, Artificial Sequence; identical to SEQ ID NO: 624
  Description of Artificial Sequence: Synthetic polypeptide

SEQ ID NO: 654 - protein, 36 aa, Artificial Sequence; identical to SEQ ID NO: 621
  Description of Artificial Sequence: Synthetic polypeptide

SEQ ID NO: 655 - protein, 36 aa, Artificial Sequence
  Description of Artificial Sequence: Synthetic polypeptide
GSGGEPSESGSSGSGGEPSESGSSGESPGGSSGSES

SEQ ID NO: 656 - protein, 36 aa, Artificial Sequence
  Description of Artificial Sequence: Synthetic polypeptide
GSEGSSGPGESSGSSESGSSEGGPGSEGSSGPGESS

SEQ ID NO: 657 - protein, 36 aa, Artificial Sequence
  Description of Artificial Sequence: Synthetic polypeptide
GSSESGSSEGGPGESPGGSSGSESGESPGGSSGSES

SEQ ID NO: 658 - protein, 36 aa, Artificial Sequence; identical to SEQ ID NO: 648
  Description of Artificial Sequence: Synthetic polypeptide

SEQ ID NO: 659 - DNA, 108 bp, Artificial Sequence
  Description of Artificial Sequence: Synthetic polynucleotide
ggttctggtggcgaaccgtccgagtctggtagctcaggtgaatctccgggtggctctagcggttccgagtcaggtgaatctcctggtggttccagcggttccgagtca

SEQ ID NO: 660 - DNA, 108 bp, Artificial Sequence
  Description of Artificial Sequence: Synthetic polynucleotide
ggtagcgaaggttcttctggtcctggcgagtcttcaggtgaatctcctggtggttccagcggttctgaatcaggttcctccgaaagcggttcttccgagggcggtcca

SEQ ID NO: 661 - DNA, 108 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtca

SEQ ID NO: 662 - DNA, 108 bp, Artificial Sequence
  Description of Artificial Sequence: Synthetic polynucleotide
ggttccggtggcgaaccgtctgaatctggtagctcaggttcttctgaaagcggttcttccgagggtggtccaggttctggtggtgaaccttccgagtctggtagctca

SEQ ID NO: 663 - DNA, 108 bp, Artificial Sequence
  Description of Artificial Sequence: Synthetic polynucleotide
ggttcttccgaaagcggttcttctgagggtggtccaggtagcgaaggttcttccggtccaggtgagtcttcaggtagcgaaggttcttctggtcctggtgaatcttca

SEQ ID NO: 664 - DNA, 108 bp, Artificial Sequence
  Description of Artificial Sequence: Synthetic polynucleotide
ggttcctctgaaagcggttcttccgagggtggtccaggtgaatctccaggtggttccagcggttctgagtcaggtagcgaaggttcttctggtccaggtgaatcctca

SEQ ID NO: 665 - DNA, 108 bp, Artificial Sequence
  Description of Artificial Sequence: Synthetic polynucleotide
ggttctggtggtgaaccgtctgagtctggtagctcaggttccggtggcgaaccatccgaatctggtagctcaggtagcgaaggttcttccggtccaggtgagtcttca

SEQ ID NO: 666 - DNA, 108 bp, Artificial Sequence
  Description of Artificial Sequence: Synthetic polynucleotide
ggttcttccgaaagcggttcttccgaaggcggtccaggtagcgaaggttcttctggtccaggcgaatcttcaggtgaatctcctggtggctccagcggttctgagtca

SEQ ID NO: 667 - DNA, 108 bp, Artificial Sequence
  Description of Artificial Sequence: Synthetic polynucleotide
ggttcctccgaaagcggttcttctgagggcggtccaggttcctccgaaagcggttcttccgagggcggtccaggttcttctgaaagcggttcttccgagggcggtcca

SEQ ID NO: 668 - DNA, 108 bp, Artificial Sequence
  Description of Artificial Sequence: Synthetic polynucleotide
ggttccggtggcgaaccgtccgaatctggtagctcaggtagcgaaggttcttctggtccaggcgaatcttcaggttcctctgaaagcggttcttctgagggcggtcca

SEQ ID NO: 669 - DNA, 108 bp, Artificial Sequence
  Description of Artificial Sequence: Synthetic polynucleotide
ggttctggtggtgaaccgtccgaatctggtagctcaggttcttccgaaagcggttcttctgaaggtggtccaggttccggtggcgaaccttctgaatctggtagctca

SEQ ID NO: 670 - DNA, 108 bp, Artificial Sequence
  Description of Artificial Sequence: Synthetic polynucleotide
ggttctggtggcgaaccgtccgaatctggtagctcaggttcctccgaaagcggttcttctgaaggtggtccaggtgaatctccaggtggttctagcggttctgaatca

SEQ ID NO: 671 - DNA, 108 bp, Artificial Sequence
  Description of Artificial Sequence: Synthetic polynucleotide
ggttctggtggcgaaccgtctgagtctggtagctcaggtgaatctcctggtggctccagcggttctgaatcaggtagcgaaggttcttctggtcctggtgaatcttca

SEQ ID NO: 672 - DNA, 108 bp, Artificial Sequence
  Description of Artificial Sequence: Synthetic polynucleotide
ggttccggtggcgaaccttccgaatctggtagctcaggtgaatctccgggtggttctagcggttctgagtcaggttctggtggtgaaccttccgagtctggtagctca

SEQ ID NO: 673 - DNA, 108 bp, Artificial Sequence
  Description of Artificial Sequence: Synthetic polynucleotide
ggttcctctgaaagcggttcttctgagggcggtccaggttcttccgaaagcggttcttccgagggcggtccaggttcttccgaaagcggttcttctgaaggcggtcca

SEQ ID NO: 674 - DNA, 108 bp, Artificial Sequence
  Description of Artificial Sequence: Synthetic polynucleotide
ggtgaatctccgggtggctccagcggttctgagtcaggtagcgaaggttcttccggtccgggtgagtcctcaggtagcgaaggttcttccggtcctggtgagtcttca

SEQ ID NO: 675 - DNA, 108 bp, Artificial Sequence
  Description of Artificial Sequence: Synthetic polynucleotide
ggttctggtggcgaaccttccgaatctggtagctcaggttccggtggtgaaccttctgaatctggtagctcaggttcttctgaaagcggttcttccgagggcggtcca

SEQ ID NO: 676 - DNA, 108 bp, Artificial Sequence
  Description of Artificial Sequence: Synthetic polynucleotide
ggttccggtggtgaaccttctgaatctggtagctcaggttccggtggcgaaccatccgagtctggtagctcaggttccggtggtgaaccatccgagtctggtagctca

SEQ ID NO: 677 - DNA, 108 bp, Artificial Sequence
  Description of Artificial Sequence: Synthetic polynucleotide
ggttccggtggcgaaccttctgaatctggtagctcaggttcctccgaaagcggttcttctgagggcggtccaggtagcgaaggttcttctggtccgggcgagtcttca

SEQ ID NO: 678 - DNA, 108 bp, Artificial Sequence
  Description of Artificial Sequence: Synthetic polynucleotide
ggttccggtggtgaaccgtccgagtctggtagctcaggtagcgaaggttcttctggtccgggtgagtcttcaggttctggtggcgaaccgtccgaatctggtagctca

SEQ ID NO: 679 - DNA, 108 bp, Artificial Sequence
  Description of Artificial Sequence: Synthetic polynucleotide
ggttctggtggcgaaccgtccgaatctggtagctcaggtgaatctcctggtggttccagcggttccgagtcaggttctggtggcgaaccttccgaatctggtagctca

SEQ ID NO: 680 - DNA, 108 bp, Artificial Sequence
  Description of Artificial Sequence: Synthetic polynucleotide
ggttcttccgaaagcggttcttccgagggcggtccaggttccggtggtgaaccatctgaatctggtagctcaggttcttctgaaagcggttcttctgaaggtggtcca

SEQ ID NO: 681 - DNA, 108 bp, Artificial Sequence
  Description of Artificial Sequence: Synthetic polynucleotide
ggtagcgaaggttcttccggtcctggtgagtcttcaggtgaatctccaggtggctctagcggttccgagtcaggtagcgaaggttcttctggtcctggcgagtcctca

SEQ ID NO: 682 - DNA, 108 bp, Artificial Sequence
  Description of Artificial Sequence: Synthetic polynucleotide
ggttcctctgaaagcggttcttccgaaggcggtccaggttcttccgaaagcggttcttctgagggcggtccaggttcctccgaaagcggttcttctgagggtggtcca

SEQ ID NO: 683 - DNA, 108 bp, Artificial Sequence
  Description of Artificial Sequence: Synthetic polynucleotide
ggttctggtggcgaaccttccgagtctggtagctcaggtgaatctccgggtggttctagcggttccgagtcaggtgaatctccgggtggttccagcggttctgagtca

SEQ ID NO: 684 - DNA, 108 bp, Artificial Sequence
  Description of Artificial Sequence: Synthetic polynucleotide
ggttctggtggcgaaccatctgagtctggtagctcaggtagcgaaggttcttccggtccaggcgagtcttcaggtgaatctcctggtggctccagcggttctgagtca

SEQ ID NO: 685 - DNA, 108 bp, Artificial Sequence
  Description of Artificial Sequence: Synthetic polynucleotide
ggtgaatctcctggtggttccagcggttccgagtcaggtgaatctccaggtggctctagcggttccgagtcaggtgaatctcctggtggttctagcggttctgaatca

SEQ ID NO: 686 - DNA, 108 bp, Artificial Sequence
  Description of Artificial Sequence: Synthetic polynucleotide
ggtagcgaaggttcttccggtccaggtgaatcttcaggtagcgaaggttcttctggtcctggtgaatcctcaggttccggtggcgaaccatctgaatctggtagctca

SEQ ID NO: 687 - DNA, 108 bp, Artificial Sequence
  Description of Artificial Sequence: Synthetic polynucleotide
ggttctggtggcgaaccatccgaatctggtagctcaggtagcgaaggttcttctggtcctggcgaatcttcaggtgaatctccaggtggctctagcggttccgaatca

SEQ ID NO: 688 - DNA, 108 bp, Artificial Sequence
  Description of Artificial Sequence: Synthetic polynucleotide
ggttccggtggtgaaccgtccgaatctggtagctcaggttcctctgaaagcggttcttccgagggtggtccaggttccggtggtgaaccttctgagtctggtagctca

SEQ ID NO: 689 - DNA, 108 bp, Artificial Sequence
  Description of Artificial Sequence: Synthetic polynucleotide
ggttcctctgaaagcggttcttctgagggcggtccaggttctggtggcgaaccatctgaatctggtagctcaggtagcgaaggttcttccggtccgggtgaatcttca

SEQ ID NO: 690 - DNA, 108 bp, Artificial Sequence
  Description of Artificial Sequence: Synthetic polynucleotide
ggttctggtggtgaaccgtccgaatctggtagctcaggtagcgaaggttcttctggtcctggcgagtcttcaggtagcgaaggttcttctggtcctggtgaatcttca

SEQ ID NO: 691 - DNA, 108 bp, Artificial Sequence
  Description of Artificial Sequence: Synthetic polynucleotide
ggttctggtggcgaaccatccgagtctggtagctcaggttcttccgaaagcggttcttccgaaggcggtccaggttctggtggtgaaccgtccgaatctggtagctca

SEQ ID NO: 692 - DNA, 108 bp, Artificial Sequence
  Description of Artificial Sequence: Synthetic polynucleotide
ggttccggtggcgaaccttccgaatctggtagctcaggtgaatctccgggtggttctagcggttccgaatcaggtgaatctccaggtggttctagcggttccgaatca

SEQ ID NO: 693 - DNA, 108 bp, Artificial Sequence
  Description of Artificial Sequence: Synthetic polynucleotide
ggttccggtggtgaaccatctgagtctggtagctcaggttccggtggcgaaccgtccgagtctggtagctcaggtgaatctccgggtggttccagcggttccgaatca

SEQ ID NO: 694 - DNA, 108 bp, Artificial Sequence
  Description of Artificial Sequence: Synthetic polynucleotide
ggtagcgaaggttcttctggtccgggcgaatcctcaggttcctccgaaagcggttcttccgaaggtggtccaggtagcgaaggttcttccggtcctggtgaatcttca

SEQ ID NO: 695 - DNA, 108 bp, Artificial Sequence
  Description of Artificial Sequence: Synthetic polynucleotide
ggttcctctgaaagcggttcttctgaaggcggtccaggtgaatctccgggtggctccagcggttctgaatcaggtgaatctcctggtggctccagcggttccgagtca

SEQ ID NO: 696 - DNA, 108 bp, Artificial Sequence
  Description of Artificial Sequence: Synthetic polynucleotide
ggtagcgaaggttcttctggtccaggcgagtcttcaggtagcgaaggttcttccggtcctggcgagtcttcaggttccggtggcgaaccgtccgaatctggtagctca

SEQ ID NO: 697 - DNA, 36 bp, Artificial Sequence
  Description of Artificial Sequence: Synthetic oligonucleotide
aggtagcccdgcwggytctccdacytcyacygarga

SEQ ID NO: 698 - DNA, 36 bp, Artificial Sequence
  Description of Artificial Sequence: Synthetic oligonucleotide
accttcytcrgtrgargthggagarccwgchgggct

SEQ ID NO: 699 - DNA, 36 bp, Artificial Sequence
  Description of Artificial Sequence: Synthetic oligonucleotide
aggtagcgaacckgcwacytcyggytctgaracycc

SEQ ID NO: 700 - DNA, 36 bp, Artificial Sequence
  Description of Artificial Sequence: Synthetic oligonucleotide
acctggrgtytcagarccrgargtwgcmggttcgct

SEQ ID NO: 701 - DNA, 36 bp, Artificial Sequence
  Description of Artificial Sequence: Synthetic oligonucleotide
aggtacytctgaaagcgcwacycckgartcyggycc

SEQ ID NO: 702 - DNA, 36 bp, Artificial Sequence
  Description of Artificial Sequence: Synthetic oligonucleotide
acctggrccrgaytcmggrgtwgcgctttcagargt

SEQ ID NO: 703 - DNA, 36 bp, Artificial Sequence
  Description of Artificial Sequence: Synthetic oligonucleotide
aggtacytctacygaaccktcygarggyagcgcwcc

SEQ ID NO: 704 - DNA, 36 bp, Artificial Sequence
  Description of Artificial Sequence: Synthetic oligonucleotide
acctggwgcgctrccytcrgamggttcrgtagargt

SEQ ID NO: 705 - protein, 36 aa, Artificial Sequence
  Description of Artificial Sequence: Synthetic polypeptide
GSPAGSPTSTEEGTSESATPESGPGTSTEPSEGSAP

SEQ ID NO: 706 - protein, 36 aa, Artificial Sequence
  Description of Artificial Sequence: Synthetic polypeptide
GTSTEPSEGSAPGTSTEPSEGSAPGTSTEPSEGSAP

SEQ ID NO: 707 - protein, 36 aa, Artificial Sequence
  Description of Artificial Sequence: Synthetic polypeptide
GTSTEPSEGSAPGTSESATPESGPGTSESATPESGP

SEQ ID NO: 708 - protein, 36 aa, Artificial Sequence; identical to SEQ ID NO: 707
  Description of Artificial Sequence: Synthetic polypeptide

SEQ ID NO: 709 - protein, 36 aa, Artificial Sequence
  Description of Artificial Sequence: Synthetic polypeptide
GSEPATSGSETPGTSESATPESGPGSPAGSPTSTEE

SEQ ID NO: 710 - protein, 36 aa, Artificial Sequence
  Description of Artificial Sequence: Synthetic polypeptide
GTSESATPESGPGSEPATSGSETPGTSTEPSEGSAP

SEQ ID NO: 711 - protein, 36 aa, Artificial Sequence
  Description of Artificial Sequence: Synthetic polypeptide
GSPAGSPTSTEEGSPAGSPTSTEEGSEPATSGSETP

SEQ ID NO: 712 - protein, 36 aa, Artificial Sequence; identical to SEQ ID NO: 705
  Description of Artificial Sequence: Synthetic polypeptide

SEQ ID NO: 713 - protein, 36 aa, Artificial Sequence
  Description of Artificial Sequence: Synthetic polypeptide
GSPAGSPTSTEEGSPAGSPTSTEEGTSTEPSEGSAP

SEQ ID NO: 714 - protein, 36 aa, Artificial Sequence
  Description of Artificial Sequence: Synthetic polypeptide
GTSESATPESGPGTSTEPSEGSAPGTSTEPSEGSAP

SEQ ID NO: 715 - protein, 36 aa, Artificial Sequence
  Description of Artificial Sequence: Synthetic polypeptide
GTSTEPSEGSAPGSPAGSPTSTEEGTSTEPSEGSAP

SEQ ID NO: 716 - protein, 36 aa, Artificial Sequence
  Description of Artificial Sequence: Synthetic polypeptide
GSEPATSGSETPGSPAGSPTSTEEGTSESATPESGP

SEQ ID NO: 717 - protein, 36 aa, Artificial Sequence; identical to SEQ ID NO: 707
  Description of Artificial Sequence: Synthetic polypeptide

SEQ ID NO: 718 - protein, 36 aa, Artificial Sequence
  Description of Artificial Sequence: Synthetic polypeptide
GTSTEPSEGSAPGSEPATSGSETPGSPAGSPTSTEE

SEQ ID NO: 719 - protein, 36 aa, Artificial Sequence
  Description of Artificial Sequence: Synthetic polypeptide
GSPAGSPTSTEEGTSESATPESGPGSEPATSGSETP

SEQ ID NO: 720 - protein, 36 aa, Artificial Sequence
  Description of Artificial Sequence: Synthetic polypeptide
GTSESATPESGPGSPAGSPTSTEEGSPAGSPTSTEE

SEQ ID NO: 721 - protein, 36 aa, Artificial Sequence
  Description of Artificial Sequence: Synthetic polypeptide
GTSTEPSEGSAPGTSESATPESGPGTSTEPSEGSAP

SEQ ID NO: 722 - protein, 36 aa, Artificial Sequence
  Description of Artificial Sequence: Synthetic polypeptide
GSPAGSPTSTEEGTSTEPSEGSAPGSEPATSGSETP

SEQ ID NO: 723 - protein, 36 aa, Artificial Sequence
  Description of Artificial Sequence: Synthetic polypeptide
GSPAGSPTSTEEGTSTEPSEGSAPGTSTEPSEGSAP

SEQ ID NO: 724 - protein, 36 aa, Artificial Sequence; identical to SEQ ID NO: 709
  Description of Artificial Sequence: Synthetic polypeptide

SEQ ID NO: 725 - protein, 36 aa, Artificial Sequence; identical to SEQ ID NO: 714
  Description of Artificial Sequence: Synthetic polypeptide

SEQ ID NO: 726 - protein, 36 aa, Artificial Sequence; identical to SEQ ID NO: 723
  Description of Artificial Sequence: Synthetic polypeptide

SEQ ID NO: 727 - protein, 36 aa, Artificial Sequence; identical to SEQ ID NO: 706
  Description of Artificial Sequence: Synthetic polypeptide

SEQ ID NO: 728 - protein, 36 aa, Artificial Sequence
  Description of Artificial Sequence: Synthetic polypeptide
GSEPATSGSETPGTSESATPESGPGTSTEPSEGSAP

SEQ ID NO: 729 - protein, 36 aa, Artificial Sequence; identical to SEQ ID NO: 715
  Description of Artificial Sequence: Synthetic polypeptide

SEQ ID NO: 730 - protein, 36 aa, Artificial Sequence
  Description of Artificial Sequence: Synthetic polypeptide
GSEPATSGSETPGTSESATPESGPGSEPATSGSETP

SEQ ID NO: 731 - protein, 36 aa, Artificial Sequence; identical to SEQ ID NO: 730
  Description of Artificial Sequence: Synthetic polypeptide

SEQ ID NO: 732 - protein, 36 aa, Artificial Sequence
  Description of Artificial Sequence: Synthetic polypeptide
GSEPATSGSETPGSEPATSGSETPGTSTEPSEGSAP

SEQ ID NO: 733 - protein, 36 aa, Artificial Sequence
  Description of Artificial Sequence: Synthetic polypeptide
GTSESATPESGPGSEPATSGSETPGSEPATSGSETP

SEQ ID NO: 734 - protein, 36 aa, Artificial Sequence
  Description of Artificial Sequence: Synthetic polypeptide
GTSTEPSEGSAPGTSTEPSEGSAPGTSESATPESGP

SEQ ID NO: 735 - protein, 36 aa, Artificial Sequence
  Description of Artificial Sequence: Synthetic polypeptide
GSEPATSGSETPGTSESATPESGPGTSESATPESGP

SEQ ID NO: 736 - protein, 36 aa, Artificial Sequence; identical to SEQ ID NO: 732
  Description of Artificial Sequence: Synthetic polypeptide

SEQ ID NO: 737 - protein, 36 aa, Artificial Sequence
  Description of Artificial Sequence: Synthetic polypeptide
GSEPATSGSETPGTSTEPSEGSAPGSEPATSGSETP

SEQ ID NO: 738 - protein, 36 aa, Artificial Sequence
  Description of Artificial Sequence: Synthetic polypeptide
GTSTEPSEGSAPGTSTEPSEGSAPGSEPATSGSETP

SEQ ID NO: 739 - protein, 36 aa, Artificial Sequence; identical to SEQ ID NO: 718
  Description of Artificial Sequence: Synthetic polypeptide

SEQ ID NO: 740 - protein, 36 aa, Artificial Sequence; identical to SEQ ID NO: 716
  Description of Artificial Sequence: Synthetic polypeptide

SEQ ID NO: 741 - protein, 36 aa, Artificial Sequence
  Description of Artificial Sequence: Synthetic polypeptide
GTSESATPESGPGSEPATSGSETPGTSESATPESGP

SEQ ID NO: 742 - DNA, 108 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcacca

SEQ ID NO: 743 - DNA, 108 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcacca

SEQ ID NO: 744 - DNA, 108 bp, Artificial Sequence
  Description of Artificial Sequence: Synthetic polynucleotide
ggtacctctaccgaaccgtctgaaggtagcgcaccaggtacctctgaaagcgcaactcctgagtccggtccaggtacttctgaaagcgcaaccccggagtctggccca

SEQ ID NO: 745 - DNA, 108 bp, Artificial Sequence
  Description of Artificial Sequence: Synthetic polynucleotide
ggtacttctactgaaccgtctgaaggtagcgcaccaggtacttctgaaagcgcaaccccggaatccggcccaggtacctctgaaagcgcaaccccggagtccggccca

SEQ ID NO: 746 - DNA, 108 bp, Artificial Sequence
  Description of Artificial Sequence: Synthetic polynucleotide
ggtagcgaaccggcaacctccggctctgaaaccccaggtacctctgaaagcgctactcctgaatccggcccaggtagcccggcaggttctccgacttccactgaggaa

SEQ ID NO: 747 - DNA, 108 bp, Artificial Sequence
  Description of Artificial Sequence: Synthetic polynucleotide
ggtacttctgaaagcgcaacccctgaatccggtccaggtagcgaaccggctacttctggctctgagactccaggtacttctaccgaaccgtccgaaggtagcgcacca

SEQ ID NO: 748 - DNA, 108 bp, Artificial Sequence
  Description of Artificial Sequence: Synthetic polynucleotide
ggtagcccggctggctctccaacctccactgaggaaggtagcccggctggctctccaacctccactgaagaaggtagcgaaccggctacctccggctctgaaactcca

SEQ ID NO: 749 - DNA, 108 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctcca

SEQ ID NO: 750 - DNA, 108 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctcca

SEQ ID NO: 751 - DNA, 108 bp, Artificial Sequence
  Description of Artificial Sequence: Synthetic polynucleotide
ggtacttctgaaagcgctactccggagtccggtccaggtacctctaccgaaccgtccgaaggcagcgctccaggtacttctactgaaccttctgagggtagcgctcca

SEQ ID NO: 752 - DNA, 108 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcacca

SEQ ID NO: 753 - DNA, 108 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggccca

SEQ ID NO: 754 - DNA, 108 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtcca

SEQ ID NO: 755 - DNA, 108 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaa

SEQ ID NO: 756 - DNA, 108 bp, Artificial Sequence
  Description of Artificial Sequence: Synthetic polynucleotide
ggtagccctgctggctctccaacctccaccgaagaaggtacctctgaaagcgcaacccctgaatccggcccaggtagcgaaccggcaacctccggttctgaaacccca

SEQ ID NO: 757 - DNA, 108 bp, Artificial Sequence
  Description of Artificial Sequence: Synthetic polynucleotide
ggtacttctgaaagcgctactcctgagtccggcccaggtagcccggctggctctccgacttccaccgaggaaggtagcccggctggctctccaacttctactgaagaa

SEQ ID NO: 758 - DNA, 108 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcacca

SEQ ID NO: 759 - DNA, 108 bp, Artificial Sequence
  Description of Artificial Sequence: Synthetic polynucleotide
ggtagcccggcaggctctccgacttccaccgaggaaggtacctctactgaaccttctgagggtagcgctccaggtagcgaaccggcaacctctggctctgaaacccca

SEQ ID NO: 760 - DNA, 108 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctcca

SEQ ID NO: 761 - DNA, 108 bp, Artificial Sequence
  Description of Artificial Sequence: Synthetic polynucleotide
ggtagcgaacctgctacctccggttctgaaaccccaggtacctctgaaagcgcaactccggagtctggtccaggtagccctgcaggttctcctacctccactgaggaa

SEQ ID NO: 762 - DNA, 108 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcacca

SEQ ID NO: 763 - DNA, 108 bp, Artificial Sequence
  Description of Artificial Sequence: Synthetic polynucleotide
ggtagcccggctggttctccgacttccaccgaggaaggtacctctactgaaccttctgagggtagcgctccaggtacctctactgaaccttccgaaggcagcgctcca

SEQ ID NO: 764 - DNA, 108 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcacca

SEQ ID NO: 765 - DNA, 108 bp, Artificial Sequence
  Description of Artificial Sequence: Synthetic polynucleotide
ggtagcgaacctgcaacctctggctctgaaaccccaggtacctctgaaagcgctactcctgaatctggcccaggtacttctactgaaccgtccgagggcagcgcacca

SEQ ID NO: 766 - DNA, 108 bp, Artificial Sequence
  Description of Artificial Sequence: Synthetic polynucleotide
ggtacttctaccgaaccgtccgagggtagcgcaccaggtagcccagcaggttctcctacctccaccgaggaaggtacttctaccgaaccgtccgagggtagcgcacca

SEQ ID NO: 767 - DNA, 108 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaacccca

SEQ ID NO: 768 - DNA, 108 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaacccca

SEQ ID NO: 769 - DNA, 108 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcacca

SEQ ID NO: 770 - DNA, 108 bp, Artificial Sequence
  Description of Artificial Sequence: Synthetic polynucleotide
ggtacttctgaaagcgctaccccggaatctggcccaggtagcgaaccggctacttctggttctgaaaccccaggtagcgaaccggctacctccggttctgaaactcca

SEQ ID NO: 771 - DNA, 108 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtcca

SEQ ID NO: 772 - DNA, 108 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtcca

SEQ ID NO: 773 - DNA, 108 bp, Artificial Sequence
  Description of Artificial Sequence: Synthetic polynucleotide
ggtagcgaacctgctacctccggctctgaaactccaggtagcgaaccggctacttccggttctgaaactccaggtacctctaccgaaccttccgaaggcagcgcacca

SEQ ID NO: 774 - DNA, 108 bp, Artificial Sequence
  Description of Artificial Sequence: Synthetic polynucleotide
ggtagcgaacctgctacttctggttctgaaactccaggtacttctaccgaaccgtccgagggtagcgctccaggtagcgaacctgctacttctggttctgaaactcca

SEQ ID NO: 775 - DNA, 108 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactcca

SEQ ID NO: 776 - DNA, 108 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaa

SEQ ID NO: 777 - DNA, 108 bp, Artificial Sequence
  Description of Artificial Sequence: Synthetic polynucleotide
ggtagcgaaccggctacttccggctctgagactccaggtagcccagctggttctccaacctctactgaggaaggtacttctgaaagcgctacccctgaatctggtcca

SEQ ID NO: 778 - DNA, 108 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtcca

SEQ ID NO: 779 - DNA, 36 bp, Artificial Sequence
  Description of Artificial Sequence: Synthetic oligonucleotide
aggttctacyagcgaatcyccktctggyacygcwcc

SEQ ID NO: 780 - DNA, 36 bp, Artificial Sequence
  Description of Artificial Sequence: Synthetic oligonucleotide
acctggwgcrgtrccagamggrgattcgctrgtaga

SEQ ID NO: 781 - DNA, 36 bp, Artificial Sequence
  Description of Artificial Sequence: Synthetic oligonucleotide
aggtacytctacycckgaaagcggytcygcwtctcc

SEQ ID NO: 782 - DNA, 36 bp, Artificial Sequence
  Description of Artificial Sequence: Synthetic oligonucleotide
acctggagawgcrgarccgctttcmggrgtagargt

SEQ ID NO: 783 - DNA, 36 bp, Artificial Sequence
  Description of Artificial Sequence: Synthetic oligonucleotide
aggtacytcycckagcggygaatcttctacygcwcc

SEQ ID NO: 784 - DNA, 36 bp, Artificial Sequence
  Description of Artificial Sequence: Synthetic oligonucleotide
acctggwgcrgtagaagattcrccgctmggrgargt

SEQ ID NO: 785 - DNA, 36 bp, Artificial Sequence
  Description of Artificial Sequence: Synthetic oligonucleotide
aggttcyacyagctctacygcwgaatctcckggycc

SEQ ID NO: 786 - DNA, 36 bp, Artificial Sequence
  Description of Artificial Sequence: Synthetic oligonucleotide
acctggrccmggagattcwgcrgtagagctrgtrga

SEQ ID NO: 787 - protein, 36 aa, Artificial Sequence
  Description of Artificial Sequence: Synthetic polypeptide
GTSTPESGSASPGTSPSGESSTAPGTSPSGESSTAP

SEQ ID NO: 788 - protein, 36 aa, Artificial Sequence
  Description of Artificial Sequence: Synthetic polypeptide
GTSPSGESSTAPGSTSSTAESPGPGTSPSGESSTAP

SEQ ID NO: 789 - protein, 36 aa, Artificial Sequence
  Description of Artificial Sequence: Synthetic polypeptide
GSTSSTAESPGPGTSPSGESSTAPGTSTPESGSASP

SEQ ID NO: 790 - protein, 36 aa, Artificial Sequence
  Description of Artificial Sequence: Synthetic polypeptide
GSTSSTAESPGPGSTSSTAESPGPGTSPSGESSTAP

SEQ ID NO: 791 - protein, 36 aa, Artificial Sequence; identical to SEQ ID NO: 789
  Description of Artificial Sequence: Synthetic polypeptide

SEQ ID NO: 792 - protein, 36 aa, Artificial Sequence
  Description of Artificial Sequence: Synthetic polypeptide
GSTSSTAESPGPGTSTPESGSASPGSTSESPSGTAP

SEQ ID NO: 793 - protein, 36 aa, Artificial Sequence
  Description of Artificial Sequence: Synthetic polypeptide
GSTSSTAESPGPGTSTPESGSASPGTSTPESGSASP

SEQ ID NO: 794 - protein, 36 aa, Artificial Sequence
  Description of Artificial Sequence: Synthetic polypeptide
GSTSESPSGTAPGTSPSGESSTAPGSTSESPSGTAP

SEQ ID NO: 795 - protein, 36 aa, Artificial Sequence; identical to SEQ ID NO: 790
  Description of Artificial Sequence: Synthetic polypeptide

SEQ ID NO: 796 - protein, 36 aa, Artificial Sequence; identical to SEQ ID NO: 792
  Description of Artificial Sequence: Synthetic polypeptide

SEQ ID NO: 797 - protein, 36 aa, Artificial Sequence; identical to SEQ ID NO: 790
  Description of Artificial Sequence: Synthetic polypeptide

SEQ ID NO: 798 - protein, 36 aa, Artificial Sequence
  Description of Artificial Sequence: Synthetic polypeptide
GSTSSTAESPGPGSTSESPSGTAPGSTSSTAESPGP

SEQ ID NO: 799 - protein, 36 aa, Artificial Sequence
  Description of Artificial Sequence: Synthetic polypeptide
GSTSSTAESPGPGSTSSTAESPGPGSTSSTAESPGP

SEQ ID NO: 800 - protein, 36 aa, Artificial Sequence
  Description of Artificial Sequence: Synthetic polypeptide
GSTSESPSGTAPGSTSSTAESPGPGSTSSTAESPGP

SEQ ID NO: 801 - protein, 36 aa, Artificial Sequence
  Description of Artificial Sequence: Synthetic polypeptide
GSTSESPSGTAPGSTSESPSGTAPGSTSESPSGTAP

SEQ ID NO: 802 - protein, 36 aa, Artificial Sequence; identical to SEQ ID NO: 799
  Description of Artificial Sequence: Synthetic polypeptide

SEQ ID NO: 803 - protein, 36 aa, Artificial Sequence; identical to SEQ ID NO: 790
  Description of Artificial Sequence: Synthetic polypeptide

SEQ ID NO: 804 - protein, 36 aa, Artificial Sequence
  Description of Artificial Sequence: Synthetic polypeptide
GSSPSASTGTGPGSSTPSGATGSPGSSTPSGATGSP

SEQ ID NO: 805 - protein, 36 aa, Artificial Sequence
  Description of Artificial Sequence: Synthetic polypeptide
GTSPSGESSTAPGTSTPESGSASPGSTSSTAESPGP

SEQ ID NO: 806 - protein, 36 aa, Artificial Sequence
  Description of Artificial Sequence: Synthetic polypeptide
GSTSSTAESPGPGSTSSTAESPGPGTSTPESGSASP

SEQ ID NO: 807 - protein, 36 aa, Artificial Sequence
  Description of Artificial Sequence: Synthetic polypeptide
GTSPSGESSTAPGSTSSTAESPGPGTSTPESGSASP

SEQ ID NO: 808 - protein, 36 aa, Artificial Sequence; identical to SEQ ID NO: 800
  Description of Artificial Sequence: Synthetic polypeptide

SEQ ID NO: 809 - protein, 36 aa, Artificial Sequence; identical to SEQ ID NO: 798
  Description of Artificial Sequence: Synthetic polypeptide

SEQ ID NO: 810 - protein, 36 aa, Artificial Sequence; identical to SEQ ID NO: 789
  Description of Artificial Sequence: Synthetic polypeptide

SEQ ID NO: 811 - protein, 36 aa, Artificial Sequence
  Description of Artificial Sequence: Synthetic polypeptide
GSTSESPSGTAPGSTSESPSGTAPGTSPSGESSTAP

SEQ ID NO: 812 - protein, 36 aa, Artificial Sequence
  Description of Artificial Sequence: Synthetic polypeptide
GSTSESPSGTAPGSTSESPSGTAPGTSTPESGSASP

SEQ ID NO: 813 - protein, 36 aa, Artificial Sequence
  Description of Artificial Sequence: Synthetic polypeptide
GTSTPESGSASPGSTSSTAESPGPGSTSSTAESPGP

SEQ ID NO: 814 - protein, 36 aa, Artificial Sequence; identical to SEQ ID NO: 811
  Description of Artificial Sequence: Synthetic polypeptide

SEQ ID NO: 815 - protein, 36 aa, Artificial Sequence
  Description of Artificial Sequence: Synthetic polypeptide
GSTSSTAESPGPGSTSSTAESPGPGSTSESPSGTAP

SEQ ID NO: 816 - protein, 36 aa, Artificial Sequence; identical to SEQ ID NO: 806
  Description of Artificial Sequence: Synthetic polypeptide

SEQ ID NO: 817 - protein, 36 aa, Artificial Sequence; identical to SEQ ID NO: 815
  Description of Artificial Sequence: Synthetic polypeptide

SEQ ID NO: 818 - protein, 36 aa, Artificial Sequence
  Description of Artificial Sequence: Synthetic polypeptide
GTSPSGESSTAPGSTSESPSGTAPGSTSSTAESPGP

SEQ ID NO: 819 - protein, 36 aa, Artificial Sequence
  Description of Artificial Sequence: Synthetic polypeptide
GSTSESPSGTAPGTSPSGESSTAPGSTSSTAESPGP

SEQ ID NO: 820 - protein, 36 aa, Artificial Sequence
  Description of Artificial Sequence: Synthetic polypeptide
GSTSSTAESPGPGSTSESPSGTAPGTSPSGESSTAP

SEQ ID NO: 821 - protein, 36 aa, Artificial Sequence; identical to SEQ ID NO: 812
  Description of Artificial Sequence: Synthetic polypeptide

SEQ ID NO: 822 - protein, 36 aa, Artificial Sequence
  Description of Artificial Sequence: Synthetic polypeptide
GTSTPESGSASPGSTSESPSGTAPGSTSSTAESPGP

SEQ ID NO: 823 - protein, 36 aa, Artificial Sequence
  Description of Artificial Sequence: Synthetic polypeptide
GSTSSTAESPGPGTSPSGESSTAPGTSPSGESSTAP

SEQ ID NO: 824 - protein, 36 aa, Artificial Sequence
  Description of Artificial Sequence: Synthetic polypeptide
GTSPSGESSTAPGTSPSGESSTAPGTSPSGESSTAP

SEQ ID NO: 825 - protein, 36 aa, Artificial Sequence; identical to SEQ ID NO: 792
  Description of Artificial Sequence: Synthetic polypeptide

SEQ ID NO: 826 - protein, 36 aa, Artificial Sequence
  Description of Artificial Sequence: Synthetic polypeptide
GSTSESPSGTAPGTSPSGESSTAPGTSPSGESSTAP

SEQ ID NO: 827 - protein, 36 aa, Artificial Sequence
  Description of Artificial Sequence: Synthetic polypeptide
GSTSESPSGTAPGTSTPESGSASPGSTSSTAESPGP

SEQ ID NO: 828 - protein, 36 aa, Artificial Sequence; identical to SEQ ID NO: 815
  Description of Artificial Sequence: Synthetic polypeptide

SEQ ID NO: 829 - protein, 36 aa, Artificial Sequence
  Description of Artificial Sequence: Synthetic polypeptide
GSTSESPSGTAPGTSTPESGSASPGTSTPESGSASP

SEQ ID NO: 830 - protein, 36 aa, Artificial Sequence; identical to SEQ ID NO: 829
  Description of Artificial Sequence: Synthetic polypeptide

SEQ ID NO: 831 - DNA, 108 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctcca

SEQ ID NO: 832 - DNA, 108 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctcca

SEQ ID NO: 833 - DNA, 108 bp, Artificial Sequence
  Description of Artificial Sequence: Synthetic polynucleotide
ggttccaccagctctactgctgaatctcctggtccaggtacctctcctagcggtgaatcttctactgctccaggtacttctactcctgaaagcggctctgcttctcca

SEQ ID NO: 834 - DNA, 108 bp, Artificial Sequence
  Description of Artificial Sequence: Synthetic polynucleotide
ggttctaccagctctactgcagaatctcctggcccaggttccaccagctctaccgcagaatctccgggtccaggtacttcccctagcggtgaatcttctaccgcacca

SEQ ID NO: 835 - DNA, 108 bp, Artificial Sequence
  Description of Artificial Sequence: Synthetic polynucleotide
ggttctactagctctactgctgaatctcctggcccaggtacttctcctagcggtgaatcttctaccgctccaggtacctctactccggaaagcggttctgcatctcca

SEQ ID NO: 836 - DNA, 108 bp, Artificial Sequence
  Description of Artificial Sequence: Synthetic polynucleotide
ggttctaccagctctaccgcagaatctcctggtccaggtacctctactccggaaagcggctctgcatctccaggttctactagcgaatctccttctggcactgcacca

SEQ ID NO: 837 - DNA, 108 bp, Artificial Sequence
  Description of Artificial Sequence: Synthetic polynucleotide
ggttctactagctctactgcagaatctcctggcccaggtacctctactccggaaagcggctctgcatctccaggtacttctacccctgaaagcggttctgcatctcca

SEQ ID NO: 838 - DNA, 108 bp, Artificial Sequence
  Description of Artificial Sequence: Synthetic polynucleotide
ggttctaccagcgaatctccttctggcaccgctccaggtacctctcctagcggcgaatcttctaccgctccaggttctactagcgaatctccttctggcactgcacca

SEQ ID NO: 839 - DNA, 108 bp, Artificial Sequence
  Description of Artificial Sequence: Synthetic polynucleotide
ggttccaccagctctactgcagaatctccgggcccaggttctactagctctactgcagaatctccgggtccaggtacttctcctagcggcgaatcttctaccgctcca

SEQ ID NO: 840 - DNA, 108 bp, Artificial Sequence
  Description of Artificial Sequence: Synthetic polynucleotide
ggttccactagctctactgcagaatctcctggcccaggtacctctacccctgaaagcggctctgcatctccaggttctaccagcgaatccccgtctggcaccgcacca

SEQ ID NO: 841 - DNA, 108 bp, Artificial Sequence
  Description of Artificial Sequence: Synthetic polynucleotide
ggttctactagctctactgctgaatctccgggtccaggttctaccagctctactgctgaatctcctggtccaggtacctccccgagcggtgaatcttctactgcacca

SEQ ID NO: 842 - DNA, 108 bp, Artificial Sequence
  Description of Artificial Sequence: Synthetic polynucleotide
ggttctaccagctctaccgctgaatctcctggcccaggttctaccagcgaatccccgtctggcaccgcaccaggttctactagctctaccgctgaatctccgggtcca

SEQ ID NO: 843 - DNA, 108 bp, Artificial Sequence
  Description of Artificial Sequence: Synthetic polynucleotide
ggttctaccagctctaccgcagaatctcctggcccaggttccactagctctaccgctgaatctcctggtccaggttctactagctctaccgctgaatctcctggtcca

SEQ ID NO: 844 - DNA, 108 bp, Artificial Sequence
  Description of Artificial Sequence: Synthetic polynucleotide
ggttctactagcgaatccccttctggtactgctccaggttccactagctctaccgctgaatctcctggcccaggttccactagctctactgcagaatctcctggtcca

SEQ ID NO: 845 - DNA, 108 bp, Artificial Sequence
  Description of Artificial Sequence: Synthetic polynucleotide
ggttctactagcgaatctccttctggtaccgctccaggttctaccagcgaatccccgtctggtactgctccaggttctaccagcgaatctccttctggtactgcacca

SEQ ID NO: 846 - DNA, 108 bp, Artificial Sequence
  Description of Artificial Sequence: Synthetic polynucleotide
ggttccaccagctctactgctgaatctcctggcccaggttctaccagctctactgctgaatctccgggcccaggttccaccagctctaccgctgaatctccgggtcca

SEQ ID NO: 847 - DNA, 108 bp, Artificial Sequence
  Description of Artificial Sequence: Synthetic polynucleotide
ggttccactagctctaccgcagaatctcctggtccaggttctactagctctactgctgaatctccgggtccaggtacctcccctagcggcgaatcttctaccgctcca

SEQ ID NO: 848 - DNA, 108 bp, Artificial Sequence
  Description of Artificial Sequence: Synthetic polynucleotide
ggttctagcccttctgcttccaccggtaccggcccaggtagctctactccgtctggtgcaactggctctccaggtagctctactccgtctggtgcaaccggctcccca

SEQ ID NO: 849 - DNA, 108 bp, Artificial Sequence
  Description of Artificial Sequence: Synthetic polynucleotide
ggtacttcccctagcggtgaatcttctactgctccaggtacctctactccggaaagcggctccgcatctccaggttctactagctctactgctgaatctcctggtcca

SEQ ID NO: 850 - DNA, 108 bp, Artificial Sequence
  Description of Artificial Sequence: Synthetic polynucleotide
ggttctactagctctaccgctgaatctccgggtccaggttctaccagctctactgcagaatctcctggcccaggtacttctactccggaaagcggttccgcttctcca

SEQ ID NO: 851 - DNA, 108 bp, Artificial Sequence
  Description of Artificial Sequence: Synthetic polynucleotide
ggtacttctcctagcggtgaatcttctaccgctccaggttctaccagctctactgctgaatctcctggcccaggtacttctaccccggaaagcggctccgcttctcca

SEQ ID NO: 852 - DNA, 108 bp, Artificial Sequence
  Description of Artificial Sequence: Synthetic polynucleotide
ggttctactagcgaatccccttctggtactgcaccaggttctaccagctctactgctgaatctccgggcccaggttccaccagctctaccgcagaatctcctggtcca

SEQ ID NO: 853 - DNA, 108 bp, Artificial Sequence
  Description of Artificial Sequence: Synthetic polynucleotide
ggttccaccagctctaccgctgaatctccgggcccaggttctaccagcgaatccccttctggcactgcaccaggttctactagctctaccgcagaatctccgggccca

SEQ ID NO: 854 - DNA, 108 bp, Artificial Sequence
  Description of Artificial Sequence: Synthetic polynucleotide
ggttctaccagctctactgctgaatctccgggtccaggtacttccccgagcggtgaatcttctactgcaccaggtacttctactccggaaagcggttccgcttctcca

SEQ ID NO: 855 - DNA, 108 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcacca

SEQ ID NO: 856 - DNA, 108 bp, Artificial Sequence
  Description of Artificial Sequence: Synthetic polynucleotide
ggttctaccagcgaatccccttctggtactgctccaggttctaccagcgaatccccttctggcaccgcaccaggtacttctacccctgaaagcggctccgcttctcca

SEQ ID NO: 857 - DNA, 108 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggccca

SEQ ID NO: 858 - DNA, 108 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctcca

SEQ ID NO: 859 - DNA, 108 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctcca

SEQ ID NO: 860 - DNA, 108 bp, Artificial Sequence
  Description of Artificial Sequence: Synthetic polynucleotide
ggttccaccagctctactgcagaatctcctggcccaggttctactagctctaccgcagaatctcctggtccaggtacctctactcctgaaagcggttccgcatctcca

SEQ ID NO: 861 - DNA, 108 bp, Artificial Sequence
  Description of Artificial Sequence: Synthetic polynucleotide
ggttctactagctctactgctgaatctccgggcccaggttctactagctctaccgctgaatctccgggtccaggttctactagcgaatctccttctggtaccgctcca

SEQ ID NO: 862 - DNA, 108 bp, Artificial Sequence
  Description of Artificial Sequence: Synthetic polynucleotide
ggtacctccccgagcggtgaatcttctactgcaccaggttctactagcgaatccccttctggtactgctccaggttccaccagctctactgcagaatctccgggtcca

SEQ ID NO: 863 - DNA, 108 bp, Artificial Sequence
  Description of Artificial Sequence: Synthetic polynucleotide
ggttctactagcgaatccccgtctggtactgctccaggtacttcccctagcggtgaatcttctactgctccaggttctaccagctctaccgcagaatctccgggtcca

SEQ ID NO: 864 - DNA, 108 bp, Artificial Sequence
  Description of Artificial Sequence: Synthetic polynucleotide
ggttctaccagctctaccgctgaatctcctggcccaggttctactagcgaatctccgtctggcaccgcaccaggtacttcccctagcggtgaatcttctactgcacca

SEQ ID NO: 865 - DNA, 108 bp, Artificial Sequence
  Description of Artificial Sequence: Synthetic polynucleotide
ggttctactagcgaatctccttctggcactgcaccaggttctaccagcgaatctccgtctggcactgcaccaggtacctctacccctgaaagcggttccgcttctcca

SEQ ID NO: 866 - DNA, 108 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggccca

SEQ ID NO: 867 - DNA, 108 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctcca

SEQ ID NO: 868 - DNA, 108 bp, Artificial Sequence
  Description of Artificial Sequence: Synthetic polynucleotide
ggtacctcccctagcggcgaatcttctactgctccaggtacctctcctagcggcgaatcttctaccgctccaggtacctcccctagcggtgaatcttctaccgcacca

SEQ ID NO: 869 - DNA, 108 bp, Artificial Sequence
  Description of Artificial Sequence: Synthetic polynucleotide
ggttccactagctctactgctgaatctcctggcccaggtacttctactccggaaagcggttccgcttctccaggttctactagcgaatctccgtctggcaccgcacca

SEQ ID NO: 870 - DNA, 108 bp, Artificial Sequence
  Description of Artificial Sequence: Synthetic polynucleotide
ggttctactagcgaatctccgtctggcactgctccaggtacttctcctagcggtgaatcttctaccgctccaggtacttcccctagcggcgaatcttctaccgctcca

SEQ ID NO: 871 - DNA, 108 bp, Artificial Sequence
  Description of Artificial Sequence: Synthetic polynucleotide
ggttctactagcgaatctccttctggtaccgctccaggtacttctacccctgaaagcggctccgcttctccaggttccactagctctaccgctgaatctccgggtcca

SEQ ID NO: 872 - DNA, 108 bp, Artificial Sequence
  Description of Artificial Sequence: Synthetic polynucleotide
ggttccactagctctactgctgaatctcctggcccaggttctaccagctctaccgctgaatctcctggcccaggttctaccagcgaatctccgtctggcaccgcacca

SEQ ID NO: 873 - DNA, 108 bp, Artificial Sequence
  Description of Artificial Sequence: Synthetic polynucleotide
ggttctactagcgaatccccgtctggtaccgcaccaggtacttctaccccggaaagcggctctgcttctccaggtacttctaccccggaaagcggctccgcatctcca

SEQ ID NO: 874 - DNA, 108 bp, Artificial Sequence
  Description of Artificial Sequence: Synthetic polynucleotide
ggttctactagcgaatccccgtctggtactgctccaggtacttctactcctgaaagcggttccgcttctccaggtacctctactccggaaagcggttctgcatctcca

SEQ ID NO: 875 - DNA, 36 bp, Artificial Sequence
  Description of Artificial Sequence: Synthetic oligonucleotide
aggtacycckggyagcggtacygcwtcttcytctcc

SEQ ID NO: 876 - DNA, 36 bp, Artificial Sequence
  Description of Artificial Sequence: Synthetic oligonucleotide
acctggagargaagawgcrgtaccgctrccmggrgt

SEQ ID NO: 877 - DNA, 36 bp, Artificial Sequence
  Description of Artificial Sequence: Synthetic oligonucleotide
aggtagctctacyccktctggtgcwacyggytcycc

SEQ ID NO: 878 - DNA, 36 bp, Artificial Sequence
  Description of Artificial Sequence: Synthetic oligonucleotide
acctggrgarccrgtwgcaccagamggrgtagagct

SEQ ID NO: 879 - DNA, 36 bp, Artificial Sequence
  Description of Artificial Sequence: Synthetic oligonucleotide
aggttctagcccktctgcwtcyacyggtacyggycc

SEQ ID NO: 880 - DNA, 36 bp, Artificial Sequence
  Description of Artificial Sequence: Synthetic oligonucleotide
acctggrccrgtaccrgtrgawgcagamgggctaga

SEQ ID NO: 881 - DNA, 36 bp, Artificial Sequence
  Description of Artificial Sequence: Synthetic oligonucleotide
aggtgcwtcycckggyacyagctctacyggttctcc

SEQ ID NO: 882 - DNA, 36 bp, Artificial Sequence
  Description of Artificial Sequence: Synthetic oligonucleotide
acctggagaaccrgtagagctrgtrccmggrgawgc

SEQ ID NO: 883 - protein, 36 aa, Artificial Sequence
  Description of Artificial Sequence: Synthetic polypeptide
GASPGTSSTGSPGTPGSGTASSSPGSSTPSGATGSP

SEQ ID NO: 884 - protein, 36 aa, Artificial Sequence
  Description of Artificial Sequence: Synthetic polypeptide
GSSTPSGATGSPGSSPSASTGTGPGSSTPSGATGSP

SEQ ID NO: 885 - protein, 36 aa, Artificial Sequence
  Description of Artificial Sequence: Synthetic polypeptide
GASPGTSSTGSPGSSPSASTGTGPGSSTPSGATGSP

SEQ ID NO: 886 - protein, 36 aa, Artificial Sequence
  Description of Artificial Sequence: Synthetic polypeptide
GTPGSGTASSSPGSSTPSGATGSPGASPGTSSTGSP

SEQ ID NO: 887 - protein, 36 aa, Artificial Sequence
  Description of Artificial Sequence: Synthetic polypeptide
GTPGSGTASSSPGASPGTSSTGSPGSRPSASTGTGP

SEQ ID NO: 888 - protein, 36 aa, Artificial Sequence
  Description of Artificial Sequence: Synthetic polypeptide
GASPGTSSTGSPGSSTPSGATGSPGASPGTSSTGSP

SEQ ID NO: 889 - protein, 36 aa, Artificial Sequence
  Description of Artificial Sequence: Synthetic polypeptide
GTPGSGTASSSPGSSTPSGATGSPGSSTPSGATGSP

SEQ ID NO: 890 - protein, 36 aa, Artificial Sequence
  Description of Artificial Sequence: Synthetic polypeptide
GASPGTSSTGSPGASPGTSSTGSPGASPGTSSTGSP

SEQ ID NO: 891 - protein, 36 aa, Artificial Sequence
  Description of Artificial Sequence: Synthetic polypeptide
GSSTPSGATGSPGSSPSASTGTGPGASPGTSSTGSP

SEQ ID NO: 892 - protein, 36 aa, Artificial Sequence
  Description of Artificial Sequence: Synthetic polypeptide
GSSTPSGATGSPGSSTPSGATGSPGTPGSGTASSSP

SEQ ID NO: 893 - protein, 36 aa, Artificial Sequence
  Description of Artificial Sequence: Synthetic polypeptide
GSSTPSGATGSPGSSTPSGATGSPGASPGTSSTGSP

SEQ ID NO: 894 - protein, 36 aa, Artificial Sequence
  Description of Artificial Sequence: Synthetic polypeptide
GTPGSGTASSSPGSSPSASTGTGPGSSTPSGATGSP

SEQ ID NO: 895 - protein, 36 aa, Artificial Sequence
  Description of Artificial Sequence: Synthetic polypeptide
GASPGTSSTGSPGSSPSASTGTGPGTPGSGTASSSP

SEQ ID NO: 896 - protein, 36 aa, Artificial Sequence; identical to SEQ ID NO: 893
  Description of Artificial Sequence: Synthetic polypeptide

SEQ ID NO: 897 - protein, 36 aa, Artificial Sequence
  Description of Artificial Sequence: Synthetic polypeptide
GTPGSGTASSSPGSSTPSGATGSPGSSPSASTGTGP

SEQ ID NO: 898 - protein, 36 aa, Artificial Sequence
  Description of Artificial Sequence: Synthetic polypeptide
GSSTPSGATGSPGTPGSGTASSSPGTPGSGTASSSP

SEQ ID NO: 899 - protein, 36 aa, Artificial Sequence; identical to SEQ ID NO: 886
  Description of Artificial Sequence: Synthetic polypeptide

SEQ ID NO: 900 - protein, 36 aa, Artificial Sequence; identical to SEQ ID NO: 893
  Description of Artificial Sequence: Synthetic polypeptide

SEQ ID NO: 901 - protein, 36 aa, Artificial Sequence; identical to SEQ ID NO: 883
  Description of Artificial Sequence: Synthetic polypeptide

SEQ ID NO: 902 - protein, 36 aa, Artificial Sequence
  Description of Artificial Sequence: Synthetic polypeptide
GSSPSASTGTGPGSSTPSGATGSPGTPGSGTASSSP

SEQ ID NO: 903 - protein, 36 aa, Artificial Sequence; identical to SEQ ID NO: 885
  Description of Artificial Sequence: Synthetic polypeptide

SEQ ID NO: 904 - protein, 36 aa, Artificial Sequence
  Description of Artificial Sequence: Synthetic polypeptide
GASPGTSSTGSPGSSTPSGATGSPGSSTPSGATGSP

SEQ ID NO: 905 - protein, 36 aa, Artificial Sequence
  Description of Artificial Sequence: Synthetic polypeptide
GTPGSGTASSSPGSSTPSGATGSPGTPGSGTASSSP

SEQ ID NO: 906 - protein, 36 aa, Artificial Sequence; identical to SEQ ID NO: 804
  Description of Artificial Sequence: Synthetic polypeptide

SEQ ID NO: 907 - protein, 36 aa, Artificial Sequence
  Description of Artificial Sequence: Synthetic polypeptide
GASPGTSSTGSPGSSPSASTGTGPGSSPSASTGTGP

SEQ ID NO: 908 - protein, 36 aa, Artificial Sequence
  Description of Artificial Sequence: Synthetic polypeptide
GTPGSGTASSSPGASPGTSSTGSPGASPGTSSTGSP

SEQ ID NO: 909 - protein, 36 aa, Artificial Sequence
  Description of Artificial Sequence: Synthetic polypeptide
GSSTPSGATGSPGASPGTSSTGSPGSSTPSGATGSP

SEQ ID NO: 910 - protein, 36 aa, Artificial Sequence
  Description of Artificial Sequence: Synthetic polypeptide
GSSTPSGATGSPGTPGSGTASSSPGSSTPSGATGSP

SEQ ID NO: 911 - protein, 36 aa, Artificial Sequence; identical to SEQ ID NO: 885
  Description of Artificial Sequence: Synthetic polypeptide

SEQ ID NO: 912 - protein, 36 aa, Artificial Sequence
  Description of Artificial Sequence: Synthetic polypeptide
GSSTPSGATGSPGSSTPSGATGSPGSSTPSGATGSP

SEQ ID NO: 913 - protein, 36 aa, Artificial Sequence
  Description of Artificial Sequence: Synthetic polypeptide
GASPGTSSTGSPGTPGSGTASSSPGASPGTSSTGSP

SEQ ID NO: 914 - protein, 36 aa, Artificial Sequence; identical to SEQ ID NO: 891
  Description of Artificial Sequence: Synthetic polypeptide

SEQ ID NO: 915 - protein, 36 aa, Artificial Sequence
  Description of Artificial Sequence: Synthetic polypeptide
GASPGTSSTGSPGSSTPSGATGSPGSSPSASTGTGP

SEQ ID NO: 916 - protein, 36 aa, Artificial Sequence; identical to SEQ ID NO: 886
  Description of Artificial Sequence: Synthetic polypeptide

SEQ ID NO: 917 - protein, 36 aa, Artificial Sequence; identical to SEQ ID NO: 910
  Description of Artificial Sequence: Synthetic polypeptide

SEQ ID NO: 918 - protein, 36 aa, Artificial Sequence
  Description of Artificial Sequence: Synthetic polypeptide
GSSPSASTGTGPGSSPSASTGTGPGASPGTSSTGSP

SEQ ID NO: 919 - protein, 36 aa, Artificial Sequence
  Description of Artificial Sequence: Synthetic polypeptide
GTPGSGTASSSPGSSTPSGATGSPGSNPSASTGTGP

SEQ ID NO: 920 - protein, 36 aa, Artificial Sequence
  Description of Artificial Sequence: Synthetic polypeptide
GSSPSASTGTGPGSSTPSGATGSPGASPGTSSTGSP

SEQ ID NO: 921 - protein, 36 aa, Artificial Sequence
  Description of Artificial Sequence: Synthetic polypeptide
GSSTPSGATGSPGASPGTSSTGSPGTPGSGTASSSP

SEQ ID NO: 922 - protein, 36 aa, Artificial Sequence; identical to SEQ ID NO: 912
  Description of Artificial Sequence: Synthetic polypeptide

SEQ ID NO: 923 - protein, 36 aa, Artificial Sequence; identical to SEQ ID NO: 883
  Description of Artificial Sequence: Synthetic polypeptide

SEQ ID NO: 924 - protein, 36 aa, Artificial Sequence
  Description of Artificial Sequence: Synthetic polypeptide
GSSTPSGATGSPGSSPSASTGTGPGSSPSASTGTGP

SEQ ID NO: 925 - protein, 36 aa, Artificial Sequence; identical to SEQ ID NO: 907
  Description of Artificial Sequence: Synthetic polypeptide

SEQ ID NO: 926 - protein, 36 aa, Artificial Sequence; identical to SEQ ID NO: 895
  Description of Artificial Sequence: Synthetic polypeptide

SEQ ID NO: 927 - DNA, 108 bp, Artificial Sequence
  Description of Artificial Sequence: Synthetic polynucleotide
ggtgcatccccgggcactagctctaccggttctccaggtactcctggtagcggtactgcttcttcttctccaggtagctctactccttctggtgctactggttctcca

SEQ ID NO: 928 - DNA, 108 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctcca

SEQ ID NO: 929 - DNA, 108 bp, Artificial Sequence
  Description of Artificial Sequence: Synthetic polynucleotide
ggtgcatctccgggtactagctctaccggttctccaggttctagcccttctgcttccactggtaccggcccaggtagctctaccccgtctggtgctactggttcccca

SEQ ID NO: 930 - DNA, 108 bp, Artificial Sequence
  Description of Artificial Sequence: Synthetic polynucleotide
ggtactccgggcagcggtactgcttcttcctctccaggtagctctaccccttctggtgcaactggttccccaggtgcatcccctggtactagctctaccggttctcca

SEQ ID NO: 931 - DNA, 108 bp, Artificial Sequence
  Description of Artificial Sequence: Synthetic polynucleotide
ggtacccctggcagcggtactgcttcttcttctccaggtgcttcccctggtaccagctctaccggttctccaggttctagaccttctgcatccaccggtactggtcca

SEQ ID NO: 932 - DNA, 108 bp, Artificial Sequence
  Description of Artificial Sequence: Synthetic polynucleotide
ggtgcatctcctggtaccagctctaccggttctccaggtagctctactccttctggtgctactggctctccaggtgcttccccgggtaccagctctaccggttctcca

SEQ ID NO: 933 - DNA, 108 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctcccca

SEQ ID NO: 934 - DNA, 108 bp, Artificial Sequence
  Description of Artificial Sequence: Synthetic polynucleotide
ggtgcatctccgggcactagctctactggttctccaggtgcatcccctggcactagctctactggttctccaggtgcttctcctggtaccagctctactggttctcca

SEQ ID NO: 935 - DNA, 108 bp, Artificial Sequence
  Description of Artificial Sequence: Synthetic polynucleotide
ggtagctctactccgtctggtgcaaccggctccccaggttctagcccgtctgcttccactggtactggcccaggtgcttccccgggcaccagctctactggttctcca

SEQ ID NO: 936 - DNA, 108 bp, Artificial Sequence
  Description of Artificial Sequence: Synthetic polynucleotide
ggtagctctactccttctggtgctaccggttccccaggtagctctactccttctggtgctactggttccccaggtactccgggcagcggtactgcttcttcctctcca

SEQ ID NO: 937 - DNA, 108 bp, Artificial Sequence
  Description of Artificial Sequence: Synthetic polynucleotide
ggtagctctactccgtctggtgcaaccggttccccaggtagctctactccttctggtgctactggctccccaggtgcatcccctggcaccagctctaccggttctcca

SEQ ID NO: 938 - DNA, 108 bp, Artificial Sequence
  Description of Artificial Sequence: Synthetic polynucleotide
ggtactcctggtagcggtaccgcatcttcctctccaggttctagcccttctgcatctaccggtaccggtccaggtagctctactccttctggtgctactggctctcca

SEQ ID NO: 939 - DNA, 108 bp, Artificial Sequence
  Description of Artificial Sequence: Synthetic polynucleotide
ggtgcttccccgggcactagctctaccggttctccaggttctagcccttctgcatctactggtactggcccaggtactccgggcagcggtactgcttcttcctctcca

SEQ ID NO: 940 - DNA, 108 bp, Artificial Sequence
  Description of Artificial Sequence: Synthetic polynucleotide
ggtagctctactccgtctggtgctaccggctctccaggtagctctaccccttctggtgcaaccggctccccaggtgcttctccgggtaccagctctactggttctcca

SEQ ID NO: 941 - DNA, 108 bp, Artificial Sequence
  Description of Artificial Sequence: Synthetic polynucleotide
ggtacccctggcagcggtaccgcttcttcctctccaggtagctctaccccgtctggtgctactggctctccaggttctagcccgtctgcatctaccggtaccggccca

SEQ ID NO: 942 - DNA, 108 bp, Artificial Sequence
  Description of Artificial Sequence: Synthetic polynucleotide
ggtagctctactccttctggtgcaaccggctccccaggtaccccgggcagcggtaccgcatcttcctctccaggtactccgggtagcggtactgcttcttcttctcca

SEQ ID NO: 943 - DNA, 108 bp, Artificial Sequence
  Description of Artificial Sequence: Synthetic polynucleotide
ggtaccccgggtagcggtactgcttcttcctctccaggtagctctaccccttctggtgcaaccggctctccaggtgcttctccgggcaccagctctaccggttctcca

SEQ ID NO: 944 - DNA, 108 bp, Artificial Sequence
  Description of Artificial Sequence: Synthetic polynucleotide
ggtagctctaccccgtctggtgctaccggctctccaggtagctctaccccgtctggtgcaaccggctccccaggtgcatccccgggtactagctctaccggttctcca

SEQ ID NO: 945 - DNA, 108 bp, Artificial Sequence
  Description of Artificial Sequence: Synthetic polynucleotide
ggtgcttctccgggcaccagctctactggttctccaggtaccccgggcagcggtaccgcatcttcttctccaggtagctctactccttctggtgcaactggttctcca

SEQ ID NO: 946 - DNA, 108 bp, Artificial Sequence
  Description of Artificial Sequence: Synthetic polynucleotide
ggttctagcccgtctgcttccaccggtactggcccaggtagctctaccccgtctggtgcaactggttccccaggtacccctggtagcggtaccgcttcttcttctcca

SEQ ID NO: 947 - DNA, 108 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctcca

SEQ ID NO: 948 - DNA, 108 bp, Artificial Sequence
  Description of Artificial Sequence: Synthetic polynucleotide
ggtgcatccccgggcaccagctctaccggttctccaggtagctctaccccgtctggtgctaccggctctccaggtagctctaccccgtctggtgctactggctctcca

SEQ ID NO: 949 - DNA, 108 bp, Artificial Sequence
  Description of Artificial Sequence: Synthetic polynucleotide
ggtacccctggtagcggtactgcttcttcctctccaggtagctctactccgtctggtgctaccggttctccaggtaccccgggtagcggtaccgcatcttcttctcca

SEQ ID NO: 950 - DNA, 108 bp, Artificial Sequence
  Description of Artificial Sequence: Synthetic polynucleotide
ggttctagcccttctgcttccaccggtactggcccaggtagctctaccccttctggtgctaccggctccccaggtagctctactccttctggtgcaactggctctcca

SEQ ID NO: 951 - DNA, 108 bp, Artificial Sequence
  Description of Artificial Sequence: Synthetic polynucleotide
ggtgcttctcctggcaccagctctactggttctccaggttctagcccttctgcttctaccggtactggtccaggttctagcccttctgcatccactggtactggtcca

SEQ ID NO: 952 - DNA, 108 bp, Artificial Sequence
  Description of Artificial Sequence: Synthetic polynucleotide
ggtactcctggcagcggtaccgcttcttcttctccaggtgcttctcctggtactagctctactggttctccaggtgcttctccgggcactagctctactggttctcca

SEQ ID NO: 953 - DNA, 108 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctcca

SEQ ID NO: 954 - DNA, 108 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctcca

SEQ ID NO: 955 - DNA, 108 bp, Artificial Sequence
  Description of Artificial Sequence: Synthetic polynucleotide
ggtgcatctcctggtaccagctctactggttctccaggttctagcccttctgcttctaccggtaccggtccaggtagctctactccttctggtgctaccggttctcca

SEQ ID NO: 956 - DNA, 108 bp, Artificial Sequence
  Description of Artificial Sequence: Synthetic polynucleotide
ggtagctctaccccgtctggtgctactggctctccaggtagctctactccttctggtgctactggttccccaggtagctctaccccgtctggtgcaactggctctcca

SEQ ID NO: 957 - DNA, 108 bp, Artificial Sequence
  Description of Artificial Sequence: Synthetic polynucleotide
ggtgcatccccgggtaccagctctaccggttctccaggtactcctggcagcggtactgcatcttcctctccaggtgcttctccgggcaccagctctactggttctcca

SEQ ID NO: 958 - DNA, 108 bp, Artificial Sequence
  Description of Artificial Sequence: Synthetic polynucleotide
ggtagctctactccttctggtgcaactggttctccaggttctagcccgtctgcatccactggtaccggtccaggtgcttcccctggcaccagctctaccggttctcca

SEQ ID NO: 959 - DNA, 108 bp, Artificial Sequence
  Description of Artificial Sequence: Synthetic polynucleotide
ggtgcatctcctggtactagctctactggttctccaggtagctctactccgtctggtgcaaccggctctccaggttctagcccttctgcatctaccggtactggtcca

SEQ ID NO: 960 - DNA, 108 bp, Artificial Sequence
  Description of Artificial Sequence: Synthetic polynucleotide
ggtactcctggcagcggtaccgcatcttcctctccaggtagctctactccgtctggtgcaactggttccccaggtgcttctccgggtaccagctctaccggttctcca

SEQ ID NO: 961 - DNA, 108 bp, Artificial Sequence
  Description of Artificial Sequence: Synthetic polynucleotide
ggtagctctaccccgtctggtgcaaccggctccccaggtactcctggtagcggtaccgcttcttcttctccaggtagctctactccgtctggtgctaccggctcccca

SEQ ID NO: 962 - DNA, 108 bp, Artificial Sequence
  Description of Artificial Sequence: Synthetic polynucleotide
ggttctagcccttctgcatccaccggtaccggcccaggttctagcccgtctgcttctaccggtactggtccaggtgcttctccgggtactagctctactggttctcca

SEQ ID NO: 963 - DNA, 108 bp, Artificial Sequence
  Description of Artificial Sequence: Synthetic polynucleotide
ggtaccccgggtagcggtaccgcttcttcttctccaggtagctctactccgtctggtgctaccggctctccaggttctaacccttctgcatccaccggtaccggccca

SEQ ID NO: 964 - DNA, 108 bp, Artificial Sequence
  Description of Artificial Sequence: Synthetic polynucleotide
ggttctagcccttctgcatctactggtactggcccaggtagctctactccttctggtgctaccggctctccaggtgcttctccgggtactagctctaccggttctcca

SEQ ID NO: 965 - DNA, 108 bp, Artificial Sequence
  Description of Artificial Sequence: Synthetic polynucleotide
ggtagctctaccccttctggtgcaaccggctctccaggtgcatccccgggtaccagctctaccggttctccaggtactccgggtagcggtaccgcttcttcctctcca

SEQ ID NO: 966 - DNA, 108 bp, Artificial Sequence
  Description of Artificial Sequence: Synthetic polynucleotide
ggtagctctactccgtctggtgcaaccggttccccaggtagctctaccccttctggtgcaaccggctccccaggtagctctaccccttctggtgcaactggctctcca

SEQ ID NO: 967 - DNA, 108 bp, Artificial Sequence
  Description of Artificial Sequence: Synthetic polynucleotide
ggtgcttctcctggcactagctctaccggttctccaggtacccctggtagcggtaccgcatcttcctctccaggtagctctactccttctggtgctactggttcccca

SEQ ID NO: 968 - DNA, 108 bp, Artificial Sequence
  Description of Artificial Sequence: Synthetic polynucleotide
ggtagctctaccccgtctggtgctactggctccccaggttctagcccttctgcatccaccggtaccggtccaggttctagcccgtctgcatctactggtactggtcca

SEQ ID NO: 969 - DNA, 108 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtcca

SEQ ID NO: 970 - DNA, 108 bp, Artificial Sequence
  Description of Artificial Sequence: Synthetic polynucleotide
ggtgcttccccgggtaccagctctaccggttctccaggttctagcccttctgcttctaccggtaccggtccaggtacccctggcagcggtaccgcatcttcctctcca

SEQ ID NO: 971 - DNA, 3183 bp, Artificial Sequence
  Description of Artificial Sequence: Synthetic polynucleotide
atggcaaatacaccggtatcaggcaatttgaaggttgaattctacaacagcaatccttcagatactactaactcaatcaatcctcagttcaaggttactaataccggaagcagtgcaattgatttgtccaaactcacattgagatattattatacagtagacggacagaaagatcagaccttctgggctgaccatgctgcaataatcggcagtaacggcagctacaacggaattacttcaaatgtaaaaggaacatttgtaaaaatgagttcctcaacaaataacgcagacacctaccttgaaatcagctttacaggcggaactcttgaaccgggtgcacatgttcagatacaaggtagatttgcaaagaatgactggagtaactatacacagtcaaatgactactcattcaagtctgcttcacagtttgttgaatgggatcaggtaacagcatacttgaacggtgttcttgtatggggtaaagaacccggtggcagtgtagtaggttcaggttcaggatccgaaaatctgtattttcagggtgggtctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtggtagcccggctggctcttgtacctctccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttaa

SEQ ID NO: 972 - protein, 1060 aa, Artificial Sequence
  Description of Artificial Sequence: Synthetic polypeptide
MANTPVSGNLKVEFYNSNPSDTTNSINPQFKVTNTGSSAIDLSKLTLRYYYTVDGQKDQTFWADHAAIIGSNGSYNGITSNVKGTFVKMSSSTNNADTYLEISFTGGTLEPGAHVQIQGRFAKNDWSNYTQSNDYSFKSASQFVEWDQVTAYLNGVLVWGKEPGGSVVGSGSGSENLYFQGGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGSPAGSCTSPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 973 - protein, 16 aa, Artificial Sequence
  Description of Artificial Sequence: Synthetic peptide
GRATAEAAGCGTAEAA

SEQ ID NO: 974 - protein, 6 aa, Artificial Sequence
  Description of Artificial Sequence: Synthetic peptide
TAEAAG

SEQ ID NO: 975 - protein, 8 aa, Artificial Sequence
  Description of Artificial Sequence: Synthetic peptide
GCGTAEAA

SEQ ID NO: 976 - protein, 14 aa, Artificial Sequence
  Description of Artificial Sequence: Synthetic peptide
TAEAAGCGTAEAAR

SEQ ID NO: 977 - DNA, 3270 bp, Artificial Sequence
  Description of Artificial Sequence: Synthetic polynucleotide
atggctaataccccagtgagcggcaacctgaaagtggaattctacaatagcaacccgagcgacaccaccaacagcattaatccgcagttcaaagtgaccaacacgggtagctccgcgatcgatctgtcgaagctgacgctgcgttactattacacggttgacggtcagaaagatcagacgttctgggctgaccatgcggccattattggcagcaacggttcctacaacggtatcacgagcaatgtcaaaggcacttttgttaagatgagctcttcgaccaacaatgccgatacctatctggagattagcttcaccggtggtactctggagccgggtgcacacgttcaaatccaaggtcgcttcgcaaagaatgactggagcaactatacccagtccaatgactacagcttcaaaagcgctagccaatttgttgaatgggatcaggtcaccgcatacctgaacggcgtgctggtctggggcaaggaaccgggtggtagcgttgtcggttctggcagcggatccggtcgtgcgacggcagaagccgctggctgcggtactgctgaagcggcaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaaccgctgaagccgcaggttgtggcactgcggaagctgcaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaactgcagaagcggctggttgtggcaccgccgaagcagctcgtcatcaccatcaccaccatcatcactaa

SEQ ID NO: 978 - protein, 1089 aa, Artificial Sequence
  Description of Artificial Sequence: Synthetic polypeptide
MANTPVSGNLKVEFYNSNPSDTTNSINPQFKVTNTGSSAIDLSKLTLRYYYTVDGQKDQTFWADHAAIIGSNGSYNGITSNVKGTFVKMSSSTNNADTYLEISFTGGTLEPGAHVQIQGRFAKNDWSNYTQSNDYSFKSASQFVEWDQVTAYLNGVLVWGKEPGGSVVGSGSGSGRATAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAARHHHHHHHH

SEQ ID NO: 979 - protein, 5 aa, Artificial Sequence
  Description of Artificial Sequence: Synthetic peptide
GRGSP

SEQ ID NO: 980 - protein, 9 aa, Artificial Sequence
  Description of Artificial Sequence: Synthetic peptide
GKPGTAEAA

SEQ ID NO: 981 - protein, 4 aa, Artificial Sequence
  Description of Artificial Sequence: Synthetic peptide
GKAT

SEQ ID NO: 982 - protein, 14 aa, Artificial Sequence
  Description of Artificial Sequence: Synthetic peptide
TAEAAGKPGTAEAA

SEQ ID NO: 983 - DNA, 3210 bp, Artificial Sequence
  Description of Artificial Sequence: Synthetic polynucleotide
atggctaataccccagtgagcggcaacctgaaagtggaattctacaatagcaacccgagcgacaccaccaacagcattaatccgcagttcaaagtgaccaacacgggtagctccgcgatcgatctgtcgaagctgacgctgcgttactattacacggttgacggtcagaaagatcagacgttctgggctgaccatgcggccattattggcagcaacggttcctacaacggtatcacgagcaatgtcaaaggcacttttgttaagatgagctcttcgaccaacaatgccgatacctatctggagattagcttcaccggtggtactctggagccgggtgcacacgttcaaatccaaggtcgcttcgcaaagaatgactggagcaactatacccagtccaatgactacagcttcaaaagcgctagccaatttgttgaatgggatcaggtcaccgcatacctgaacggcgtgctggtctggggcaaggaaccgggtggtagcgttgtcggttctggcagcggatccggtcgtgggtctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaaccgctgaagccgcaggtaaaccgggcactgcggaagctgcaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtaaagcgacccatcaccatcaccaccatcatcactaa

SEQ ID NO: 984 - protein, 1069 aa, Artificial Sequence
  Description of Artificial Sequence: Synthetic polypeptide
MANTPVSGNLKVEFYNSNPSDTTNSINPQFKVTNTGSSAIDLSKLTLRYYYTVDGQKDQTFWADHAAIIGSNGSYNGITSNVKGTFVKMSSSTNNADTYLEISFTGGTLEPGAHVQIQGRFAKNDWSNYTQSNDYSFKSASQFVEWDQVTAYLNGVLVWGKEPGGSVVGSGSGSGRGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGKPGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKATHHHHHHHH

SEQ ID NO: 985 - DNA, 1029 bp, Artificial Sequence
  Description of Artificial Sequence: Synthetic polynucleotide
atgaaaaacccagagcaagcagaagaacaagctgaagaacagcgcgaagaaacacgtccgcgtcctcgcccacgtccacgtccgcgtccacgccctcgtcctcgtccgcgccctcgtccgagcgcgtctcgttccgctgggtctccaacgggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaagcgcctctcgctccgcacatcaccatcaccaccatcatcactaa

SEQ ID NO: 986 - protein, 342 aa, Artificial Sequence; identical to SEQ ID NO: 375
  Description of Artificial Sequence: Synthetic polypeptide

SEQ ID NO: 987 - protein, 20 aa, Artificial Sequence
  Description of Artificial Sequence: Synthetic peptide
MAENQYYGTGRRKSSAARVF

SEQ ID NO: 988 - protein, 20 aa, Artificial Sequence
  Description of Artificial Sequence: Synthetic peptide
MAVQQNKPTRSKRGMRRSHD

SEQ ID NO: 989 - protein, 20 aa, Artificial Sequence
  Description of Artificial Sequence: Synthetic peptide
MANIKSAKKRAIQSEKARKH

SEQ ID NO: 990 - protein, 20 aa, Artificial Sequence
  Description of Artificial Sequence: Synthetic peptide
MSSKEQKTPEGQAPEEIIMD

SEQ ID NO: 991 - protein, 20 aa, Artificial Sequence
  Description of Artificial Sequence: Synthetic peptide
MAKQSMKAREVKRVALADKY

SEQ ID NO: 992 - protein, 20 aa, Artificial Sequence
  Description of Artificial Sequence: Synthetic peptide
MATVNQLVRKPRARKVAKSN

SEQ ID NO: 993 - protein, 20 aa, Artificial Sequence
  Description of Artificial Sequence: Synthetic peptide
MSKEKFERTKPHVNVGTIGH

SEQ ID NO: 994 - protein, 20 aa, Artificial Sequence
  Description of Artificial Sequence: Synthetic peptide
MSLSTEATAKIVSEFGRDAN

SEQ ID NO: 995 - protein, 20 aa, Artificial Sequence
  Description of Artificial Sequence: Synthetic peptide
MSYTLPSLPYAYDALEPHFD

SEQ ID NO: 996 - protein, 20 aa, Artificial Sequence
  Description of Artificial Sequence: Synthetic peptide
MANPEQLEEQREETRLIIEE

SEQ ID NO: 997 - protein, 20 aa, Artificial Sequence
  Description of Artificial Sequence: Synthetic peptide
MANTPVSGNLKVEFYNSNPS

SEQ ID NO: 998 - protein, 20 aa, Artificial Sequence
  Description of Artificial Sequence: Synthetic peptide
MANTPVSGNLKVEFYNSNPS

SEQ ID NO: 999 - protein, 18 aa, Artificial Sequence
  Description of Artificial Sequence: Synthetic peptide
MAENQYYGTGRRKSSAAR

SEQ ID NO: 1000 - protein, 20 aa, Artificial Sequence
  Description of Artificial Sequence: Synthetic peptide
MAAQQNKPTRSKRGARRSHD

SEQ ID NO: 1001 - protein, 20 aa, Artificial Sequence
  Description of Artificial Sequence: Synthetic peptide
MANAKSAKKRAAQSEKARKH

SEQ ID NO: 1002 - protein, 16 aa, Artificial Sequence
  Description of Artificial Sequence: Synthetic peptide
MSSKEQKTPEGQAPEE

SEQ ID NO: 1003 - protein, 20 aa, Artificial Sequence
  Description of Artificial Sequence: Synthetic peptide
MAKQSAKAREAKRAASADKY

SEQ ID NO: 1004 - protein, 20 aa, Artificial Sequence
  Description of Artificial Sequence: Synthetic peptide
MATANQAARKPRARKAAKSN

SEQ ID NO: 1005 - protein, 17 aa, Artificial Sequence
  Description of Artificial Sequence: Synthetic peptide
MSKEKAERTKPHANAGT

SEQ ID NO: 1006 - protein, 20 aa, Artificial Sequence
  Description of Artificial Sequence: Synthetic peptide
MSASTEATAKAASEAGRDAN

SEQ ID NO: 1007 - protein, 18 aa, Artificial Sequence
  Description of Artificial Sequence: Synthetic peptide
MSYTAPSAPYAYDAAEPH

SEQ ID NO: 1008 - protein, 15 aa, Artificial Sequence
  Description of Artificial Sequence: Synthetic peptide
MANPEQAEEQREETR

SEQ ID NO: 1009 - protein, 20 aa, Artificial Sequence
  Description of Artificial Sequence: Synthetic peptide
MANTPASGNAKAEAYNSNPS

SEQ ID NO: 1010 - protein, 20 aa, Artificial Sequence
  Description of Artificial Sequence: Synthetic peptide
MANTPVSGNLKVEFYNSNPS

SEQ ID NO: 1011 - DNA, 92 bp, Artificial Sequence
  Description of Artificial Sequence: Synthetic oligonucleotide
cgtccgcgtcctcgcccacgtccacgtccgcgtccacgccctcgtcctcgtccgcgccctcgtccgagcgcgtctcgttccgctgggtctcc

SEQ ID NO: 1012 - DNA, 92 bp, Artificial Sequence
  Description of Artificial Sequence: Synthetic oligonucleotide
acctggagacccagcggaacgagacgcgctcggacgagggcgcggacgaggacgagggcgtggacgcggacgtggacgtgggcgaggacgcg

SEQ ID NO: 1013 - DNA, 52 bp, Artificial Sequence
  Description of Artificial Sequence: Synthetic oligonucleotide
tatggctgaaaatcaatattatggtacggggcgccggaagagttcggccgcc

SEQ ID NO: 1014 - DNA, 54 bp, Artificial Sequence
  Description of Artificial Sequence: Synthetic oligonucleotide
gacgggcggccgaactcttccggcgccccgtaccataatattgattttcagcca

SEQ ID NO: 1015 - DNA, 61 bp, Artificial Sequence
  Description of Artificial Sequence: Synthetic oligonucleotide
tatggcagctcagcagaataagcctacacgaagtaaaagaggcgcgcgccggtcgcacgat

SEQ ID NO: 1016 - DNA, 63 bp, Artificial Sequence
  Description of Artificial Sequence: Synthetic oligonucleotide
gacgatcgtgcgaccggcgcgcgcctcttttacttcgtgtaggcttattctgctgagctgcca

SEQ ID NO: 1017 - DNA, 61 bp, Artificial Sequence
  Description of Artificial Sequence: Synthetic oligonucleotide
tatggcaaatgctaagagtgcaaagaaacgggcggcacaaagcgaaaaagctcggaaacat

SEQ ID NO: 1018 - DNA, 63 bp, Artificial Sequence
  Description of Artificial Sequence: Synthetic oligonucleotide
gacgatgtttccgagctttttcgctttgtgccgcccgtttctttgcactcttagcatttgcca

SEQ ID NO: 1019 - DNA, 49 bp, Artificial Sequence
  Description of Artificial Sequence: Synthetic oligonucleotide
tatgtccagcaaagaacagaagactccggaaggtcaagcgccagaggag

SEQ ID NO: 1020 - DNA, 51 bp, Artificial Sequence
  Description of Artificial Sequence: Synthetic oligonucleotide
gacgctcctctggcgcttgaccttccggagtcttctgttctttgctggaca

SEQ ID NO: 1021 - DNA, 61 bp, Artificial Sequence
  Description of Artificial Sequence: Synthetic oligonucleotide
tatggccaaacaaagcgctaaagcccgcgaggcgaaacgtgcagcctctgcggacaaatat

SEQ ID NO: 1022 - DNA, 63 bp, Artificial Sequence
  Description of Artificial Sequence: Synthetic oligonucleotide
gacgatatttgtccgcagaggctgcacgtttcgcctcgcgggctttagcgctttgtttggcca

SEQ ID NO: 1023 - DNA, 61 bp, Artificial Sequence
  Description of Artificial Sequence: Synthetic oligonucleotide
tatggctactgcaaatcaggccgcccgtaaacctcgagcacgaaaggctgctaaatcaaat

SEQ ID NO: 1024 - DNA, 63 bp, Artificial Sequence
  Description of Artificial Sequence: Synthetic oligonucleotide
gacgatttgatttagcagcctttcgtgctcgaggtttacgggcggcctgatttgcagtagcca

SEQ ID NO: 1025 - DNA, 52 bp, Artificial Sequence
  Description of Artificial Sequence: Synthetic oligonucleotide
tatgtccaaagaaaaagccgaacggaccaaacctcatgctaacgctggcacg

SEQ ID NO: 1026 - DNA, 54 bp, Artificial Sequence
  Description of Artificial Sequence: Synthetic oligonucleotide
gacgcgtgccagcgttagcatgaggtttggtccgttcggctttttctttggaca

SEQ ID NO: 1027 - DNA, 61 bp, Artificial Sequence
  Description of Artificial Sequence: Synthetic oligonucleotide
tatgtcagcgtctacggaggcaaccgcaaaagctgctagtgaagcgggccgtgatgcgaat

SEQ ID NO: 1028 - DNA, 63 bp, Artificial Sequence
  Description of Artificial Sequence: Synthetic oligonucleotide
gacgattcgcatcacggcccgcttcactagcagcttttgcggttgcctccgtagacgctgaca

SEQ ID NO: 1029 - DNA, 55 bp, Artificial Sequence
  Description of Artificial Sequence: Synthetic oligonucleotide
tatgagctatactgcaccgagcgcaccgtatgcttatgatgcagccgaacctcac

SEQ ID NO: 1030 - DNA, 57 bp, Artificial Sequence
  Description of Artificial Sequence: Synthetic oligonucleotide
gacggtgaggttcggctgcatcataagcatacggtgcgctcggtgcagtatagctca

SEQ ID NO: 1031 - DNA, 43 bp, Artificial Sequence
  Description of Artificial Sequence: Synthetic oligonucleotide
tatggcaaaccccgaacaggctgaggaacagagagaagaaaca

SEQ ID NO: 1032 - DNA, 45 bp, Artificial Sequence
  Description of Artificial Sequence: Synthetic oligonucleotide
gacgtgtttcttctctctgttcctcagcctgttcggggtttgcca

SEQ ID NO: 1033 - DNA, 61 bp, Artificial Sequence
  Description of Artificial Sequence: Synthetic oligonucleotide
tatggctaatacccctgcgagcgggaacgccaaggcggaagcttacaacagtaatccaagc

SEQ ID NO: 1034 - DNA, 63 bp, Artificial Sequence
  Description of Artificial Sequence: Synthetic oligonucleotide
gacggcttggattactgttgtaagcttccgccttggcgttcccgctcgcaggggtattagcca

SEQ ID NO: 1035 - DNA, 61 bp, Artificial Sequence
  Description of Artificial Sequence: Synthetic oligonucleotide
tatggcaaatacaccggtatcaggcaatttgaaggttgaattctacaacagcaatccttca

SEQ ID NO: 1036 - DNA, 63 bp, Artificial Sequence
  Description of Artificial Sequence: Synthetic oligonucleotide
gacgtgaaggattgctgttgtagaattcaaccttcaaattgcctgataccggtgtatttgcca

SEQ ID NO: 1037 - DNA, 18 bp, Artificial Sequence
  Description of Artificial Sequence: Synthetic oligonucleotide
tcgagcacgggcagccca

SEQ ID NO: 1038 - DNA, 18 bp, Artificial Sequence
  Description of Artificial Sequence: Synthetic oligonucleotide
gacgtgggctgcccgtgc

SEQ ID NO: 1039 - DNA, 51 bp, Artificial Sequence
  Description of Artificial Sequence: Synthetic oligonucleotide
tatgggctgagggtctcacgtccgcgtcctcgcccacgtccacgtccgcgt

SEQ ID NO: 1040 - DNA, 45 bp, Artificial Sequence
  Description of Artificial Sequence: Synthetic oligonucleotide
ggacgtggacgtgggcgaggacgcggacgtgagaccctcagccca

SEQ ID NO: 1041 - DNA, 50 bp, Artificial Sequence
  Description of Artificial Sequence: Synthetic oligonucleotide
ccacgccctcgtcctcgtccgcgccctcgtccgagcgcgtctcgttccgc

SEQ ID NO: 1042 - DNA, 58 bp, Artificial Sequence
  Description of Artificial Sequence: Synthetic oligonucleotide
acctgcggaacgagacgcgctcggacgagggcgcggacgaggacgagggcgtggacgc

SEQ ID NO: 1043 - DNA, 43 bp, Artificial Sequence
  Description of Artificial Sequence: Synthetic oligonucleotide
  modified_base (13)..(13): a, c, t, g, unknown or other
  modified_base (22)..(22): a, c, t, g, unknown or other
tatgaaaaayccngarcargcngargarcarmgygargaraca

SEQ ID NO: 1044 - DNA, 45 bp, Artificial Sequence
  Description of Artificial Sequence: Synthetic oligonucleotide
  modified_base (26)..(26): a, c, t, g, unknown or other
  modified_base (35)..(35): a, c, t, g, unknown or other
gacgtgtytcytcrckytgytcytcngcytgytcnggrtttttca

SEQ ID NO: 1045 - DNA, 43 bp, Artificial Sequence
  Description of Artificial Sequence: Synthetic oligonucleotide
  modified_base (7)..(7): a, c, t, g, unknown or other
  modified_base (13)..(13): a, c, t, g, unknown or other
  modified_base (22)..(22): a, c, t, g, unknown or other
tatggcnaayccngarcargcngargarcarmgygargaraca

SEQ ID NO: 1046 - DNA, 45 bp, Artificial Sequence
  Description of Artificial Sequence: Synthetic oligonucleotide
  modified_base (26)..(26): a, c, t, g, unknown or other
  modified_base (35)..(35): a, c, t, g, unknown or other
  modified_base (41)..(41): a, c, t, g, unknown or other
gacgtgtytcytcrckytgytcytcngcytgytcnggrttngcca

SEQ ID NO: 1047 - DNA, 55 bp, Artificial Sequence
  Description of Artificial Sequence: Synthetic oligonucleotide
tatgaaaaacccvgarcargcdgargaacargcdgargaacagmgygaagaraca

SEQ ID NO: 1048 - DNA, 57 bp, Artificial Sequence
  Description of Artificial Sequence: Synthetic oligonucleotide
gacgtgtytcttcrckctgttcytchgcytgttcytchgcytgytcbgggtttttca

SEQ ID NO: 1049 - DNA, 78 bp, Artificial Sequence
  Description of Artificial Sequence: Synthetic oligonucleotide
  modified_base (10)..(10): a, c, t, g, unknown or other
  modified_base (13)..(13): a, c, t, g, unknown or other
  modified_base (16)..(16): a, c, t, g, unknown or other
  modified_base (19)..(19): a, c, t, g, unknown or other
  modified_base (22)..(22): a, c, t, g, unknown or other
  modified_base (25)..(25): a, c, t, g, unknown or other
  modified_base (28)..(28): a, c, t, g, unknown or other
  modified_base (31)..(31): a, c, t, g, unknown or other
  modified_base (34)..(34): a, c, t, g, unknown or other
  modified_base (37)..(37): a, c, t, g, unknown or other
  modified_base (40)..(40): a, c, t, g, unknown or other
  modified_base (43)..(43): a, c, t, g, unknown or other
  modified_base (46)..(46): a, c, t, g, unknown or other
  modified_base (49)..(49): a, c, t, g, unknown or other
  modified_base (52)..(52): a, c, t, g, unknown or other
  modified_base (55)..(55): a, c, t, g, unknown or other
  modified_base (58)..(58): a, c, t, g, unknown or other
  modified_base (61)..(61): a, c, t, g, unknown or other
  modified_base (64)..(64): a, c, t, g, unknown or other
  modified_base (67)..(67): a, c, t, g, unknown or other
  modified_base (70)..(70): a, c, t, g, unknown or other
tatgaraccncgnccncgnccncgnccncgnccncgnccncgnccncgnccncgnccncgnccncgnccngggtctcc

SEQ ID NO: 1050 - DNA, 80 bp, Artificial Sequence
  Description of Artificial Sequence: Synthetic oligonucleotide
  modified_base (13)..(13): a, c, t, g, unknown or other
  modified_base (16)..(16): a, c, t, g, unknown or other
  modified_base (19)..(19): a, c, t, g, unknown or other
  modified_base (22)..(22): a, c, t, g, unknown or other
  modified_base (25)..(25): a, c, t, g, unknown or other
  modified_base (28)..(28): a, c, t, g, unknown or other
  modified_base (31)..(31): a, c, t, g, unknown or other
  modified_base (34)..(34): a, c, t, g, unknown or other
  modified_base (37)..(37): a, c, t, g, unknown or other
  modified_base (40)..(40): a, c, t, g, unknown or other
  modified_base (43)..(43): a, c, t, g, unknown or other
  modified_base (46)..(46): a, c, t, g, unknown or other
  modified_base (49)..(49): a, c, t, g, unknown or other
  modified_base (52)..(52): a, c, t, g, unknown or other
  modified_base (55)..(55): a, c, t, g, unknown or other
  modified_base (58)..(58): a, c, t, g, unknown or other
  modified_base (61)..(61): a, c, t, g, unknown or other
  modified_base (64)..(64): a, c, t, g, unknown or other
  modified_base (67)..(67): a, c, t, g, unknown or other
  modified_base (70)..(70): a, c, t, g, unknown or other
  modified_base (73)..(73): a, c, t, g, unknown or other
acctggagacccnggncgnggncgnggncgnggncgnggncgnggncgnggncgnggncgnggncgnggncgnggtytca

SEQ ID NO: 1051 - DNA, 55 bp, Artificial Sequence
  Description of Artificial Sequence: Synthetic oligonucleotide
tatgaaaaahmmvgarcargcwgargaacargcdgargaacagmgygaagaraca

SEQ ID NO: 1052 - DNA, 57 bp, Artificial Sequence
  Description of Artificial Sequence: Synthetic oligonucleotide
gacgtgtytcttcrckctgttcytchgcytgttcytcwgcytgytcbkkdtttttca

SEQ ID NO: 1053 - DNA, 55 bp, Artificial Sequence
  Description of Artificial Sequence: Synthetic oligonucleotide
tatgaaaaawcamrarmarrmwraaraamaarmdraaraacagmgcgaagaraca

SEQ ID NO: 1054 - DNA, 57 bp, Artificial Sequence
  Description of Artificial Sequence: Synthetic oligonucleotide
gacgtgtytcttcgckctgttyttyhkyttkttyttywkyytkytyktgwtttttca

SEQ ID NO: 1055 - DNA, 55 bp, Artificial Sequence
  Description of Artificial Sequence: Synthetic oligonucleotide
tatgaaaaawcamrarmarrmwraaraamaagcdgaagaacagmgcgaagaraca

SEQ ID NO: 1056 - DNA, 57 bp, Artificial Sequence
  Description of Artificial Sequence: Synthetic oligonucleotide
gacgtgtytcttcgckctgttcttchgcttkttyttywkyytkytyktgwtttttca

SEQ ID NO: 1057 - DNA, 55 bp, Artificial Sequence
  Description of Artificial Sequence: Synthetic oligonucleotide
  modified_base (10)..(10): a, c, t, g, unknown or other
  modified_base (34)..(34): a, c, t, g, unknown or other
tatgaaaaancmmgaacaagaaraaraamaagcngaagaacarcgygargaraca

SEQ ID NO: 1058 - DNA, 57 bp, Artificial Sequence
  Description of Artificial Sequence: Synthetic oligonucleotide
  modified_base (26)..(26): a, c, t, g, unknown or other
  modified_base (50)..(50): a, c, t, g, unknown or other
gacgtgtytcytcrcgytgttcttcngcttkttyttyttcttgttckkgntttttca

SEQ ID NO: 1059 - DNA, 55 bp, Artificial Sequence
  Description of Artificial Sequence: Synthetic oligonucleotide
  modified_base (10)..(10): a, c, t, g, unknown or other
  modified_base (34)..(34): a, c, t, g, unknown or other
tatgaaaaancmmgaacaagaaraaraamaagcngaagaamarmrhrarrarama

SEQ ID NO: 1060 - DNA, 57 bp, Artificial Sequence
  Description of Artificial Sequence: Synthetic oligonucleotide
  modified_base (26)..(26): a, c, t, g, unknown or other
  modified_base (50)..(50): a, c, t, g, unknown or other
gacgtktytyytydykytkttcttcngcttkttyttyttcttgttckkgntttttca

SEQ ID NO: 1061 - DNA, 67 bp, Artificial Sequence
  Description of Artificial Sequence: Synthetic oligonucleotide
  modified_base (46)..(46): a, c, t, g, unknown or other
  modified_base (52)..(52): a, c, t, g, unknown or other
tatgaaaaaacaagaacaagaaaaagaacaagcggaagaacaakcnvarkcnvarcgtgaggagaca

SEQ ID NO: 1062 - DNA, 69 bp, Artificial Sequence
  Description of Artificial Sequence: Synthetic oligonucleotide
  modified_base (20)..(20): a, c, t, g, unknown or other
  modified_base (26)..(26): a, c, t, g, unknown or other
gacgtgtctcctcacgytbngmytbngmttgttcttccgcttgttctttttcttgttcttgttttttca

SEQ ID NO: 1063 - DNA, 79 bp, Artificial Sequence
  Description of Artificial Sequence: Synthetic oligonucleotide
tatgaaaaaacaagaacaagaaaaagaacaagcggaagaacaakcvvaakcvvaakcvvaakcvvaacgtgaggagaca

SEQ ID NO: 1064 - DNA, 81 bp, Artificial Sequence
  Description of Artificial Sequence: Synthetic oligonucleotide
gacgtgtctcctcacgttbbgmttbbgmttbbgmttbbgmttgttcttccgcttgttctttttcttgttcttgttttttca

SEQ ID NO: 1065 - DNA, 67 bp, Artificial Sequence
  Description of Artificial Sequence: Synthetic oligonucleotide
  modified_base (44)..(55): a, c, t, g, unknown or other
tatgaaaaaacaagaacaagaaaaagaacaagcggaagaacaannnnnnnnnnnncgtgaggagaca

SEQ ID NO: 1066 - DNA, 69 bp, Artificial Sequence
  Description of Artificial Sequence: Synthetic oligonucleotide
  modified_base (17)..(28): a, c, t, g, unknown or other
gacgtgtctcctcacgnnnnnnnnnnnnttgttcttccgcttgttctttttcttgttcttgttttttca

SEQ ID NO: 1067 - DNA, 42 bp, Artificial Sequence
  Description of Artificial Sequence: Synthetic oligonucleotide
  modified_base (12)..(12): a, c, t, g, unknown or other
  modified_base (21)..(21): a, c, t, g, unknown or other
atgaaaaayccngarcargcngargarcarmgygargaraca

SEQ ID NO: 1068 - DNA, 42 bp, Artificial Sequence
  Description of Artificial Sequence: Synthetic oligonucleotide
  modified_base (6)..(6): a, c, t, g, unknown or other
  modified_base (12)..(12): a, c, t, g, unknown or other
  modified_base (21)..(21): a, c, t, g, unknown or other
atggcnaayccngarcargcngargarcarmgygargaraca

SEQ ID NO: 1069 - DNA, 54 bp, Artificial Sequence
  Description of Artificial Sequence: Synthetic oligonucleotide
atgaaaaacccvgarcargcdgargaacargcdgargaacagmgygaagaraca

SEQ ID NO: 1070 - protein, 4 aa, Artificial Sequence
  Description of Artificial Sequence: Synthetic peptide
AEEQ

SEQ ID NO: 1071 - protein, 22 aa, Artificial Sequence
  Description of Artificial Sequence: Synthetic peptide
  MOD_RES (15)..(15): Ala or Ser
  MOD_RES (16)..(16): Glu, Lys or Gln
  MOD_RES (17)..(17): Ala or Ser
  MOD_RES (18)..(18): Glu, Lys or Gln
MKKQEQEKEQAEEQXXXXREET

SEQ ID NO: 1072 - protein, 26 aa, Artificial Sequence
  Description of Artificial Sequence: Synthetic peptide
  MOD_RES (15)..(15): Ala or Ser
  MOD_RES (16)..(16): Glu, Lys or Gln
  MOD_RES (17)..(17): Ala or Ser
  MOD_RES (18)..(18): Glu, Lys or Gln
  MOD_RES (19)..(19): Ala or Ser
  MOD_RES (20)..(20): Glu, Lys or Gln
  MOD_RES (21)..(21): Ala or Ser
  MOD_RES (22)..(22): Glu, Lys or Gln
MKKQEQEKEQAEEQXXXXXXXXREET

SEQ ID NO: 1073 - protein, 22 aa, Artificial Sequence
  Description of Artificial Sequence: Synthetic peptide
  MOD_RES (15)..(18): Any amino acid
MKKQEQEKEQAEEQXXXXREET

SEQ ID NO: 1074 - protein, 22 aa, Artificial Sequence
  Description of Artificial Sequence: Synthetic peptide
MKKQEQEKEQAEEQAESEREET

SEQ ID NO: 1075 - protein, 22 aa, Artificial Sequence
  Description of Artificial Sequence: Synthetic peptide
MKKQEQEKEQAEEQAESEREET

SEQ ID NO: 1076 - protein, 22 aa, Artificial Sequence
  Description of Artificial Sequence: Synthetic peptide
MKKQEQEKEQAEEQSQSQREET

SEQ ID NO: 1077 - protein, 22 aa, Artificial Sequence
  Description of Artificial Sequence: Synthetic peptide
MKKQEQEKEQAEEQSESEREET

SEQ ID NO: 1078 - protein, 26 aa, Artificial Sequence
  Description of Artificial Sequence: Synthetic peptide
MKKQEQEKEQAEEQAKAESEAEREET

SEQ ID NO: 1079 - protein, 26 aa, Artificial Sequence
  Description of Artificial Sequence: Synthetic peptide
MKKQEQEKEQAEEQSKSQAEAEREET

SEQ ID NO: 1080 - protein, 26 aa, Artificial Sequence
  Description of Artificial Sequence: Synthetic peptide
MKKQEQEKEQAEEQAQAQAEDEREET

SEQ ID NO: 1081 - protein, 26 aa, Artificial Sequence
  Description of Artificial Sequence: Synthetic peptide
MKKQEQEKEQAEEQSKSKAEDEREET

SEQ ID NO: 1082 - protein, 22 aa, Artificial Sequence
  Description of Artificial Sequence: Synthetic peptide
MKKQEQEKEQAEEQPEVQREET

SEQ ID NO: 1083 - protein, 22 aa, Artificial Sequence
  Description of Artificial Sequence: Synthetic peptide
MKKQEQEKEQAEEQVENPREET

SEQ ID NO: 1084 - protein, 22 aa, Artificial Sequence
  Description of Artificial Sequence: Synthetic peptide
MKKQEQEKEQAEEQELCEREET

SEQ ID NO: 1085 - protein, 22 aa, Artificial Sequence
  Description of Artificial Sequence: Synthetic peptide
MKKQEQEKEQAEEQGIDTREET

SEQ ID NO: 1086 - protein, 18 aa, Artificial Sequence
  Description of Artificial Sequence: Synthetic peptide
MKNPEQAEEQAEEQREET

SEQ ID NO: 1087 - DNA, 1461 bp, Artificial Sequence
  Description of Artificial Sequence: Synthetic polynucleotide
atgaaaaacccagagcaagcagaagaacaagctgaagaacagcgcgaagaaacacgtccgcgtcctcgcccacgtccacgtccgcgtccacgccctcgtcctcgtccgcgccctcgtccgagcgcgtctcgttccgctgggtctccaacggcagaggcagcaggttgtggtacagcagaagcagctccgggtagcgagcctgcaaccagcggttctgagacgccgggcacttccgaatctgcgaccccggagtccggtccaggttcagagccggcgacgagcggttcggaaacgccgggtactgctgaagcggctggttgtggtactgctgaagctgcatcgaccgaaccaagcgaaggttcggcaccgggtactagcgagagcgcaacccctgaaagcggtccgggcagcccggcaggttctccaaccagcaccgaagaaggttcccctgctactgccgaagctgcaggctgcggtactgcggaggcggcgtccccaacttctactgaggaaggtacttctgagtccgctaccccagaaagcggtcctggtacctccactgaaccgtctgaaggctctgcaccaggcacttctgagtctgctactaccgccgaagccgctggttgtggtaccgcagaagctgcatctgagactccaggcacttctgagtccgcaacgcctgaatccggtcctggttctgaaccagctacttccggcagcgaaaccccaggtacctctgagtctgcgactccagagtctggtaccgcggaagcggctggttgtggtactgcagaggcagctggttctccggctggtagcccgaccagcacggaggagggtacgtctgaatctgcaacgccggaatcgggcccaggttcggagcctgcaacgtctggcagcgaaaccccgggtaccacggcggaagcggcaggttgtggcaccgcggaggcagcagctggttctccaacctctaccgaggagggttcaccggcaggtagcccgactagcactgaagaaggtactagcacggagccgagcgagggtagtgctccgggtacgagcgagagcacggcagaagccgctggctgcggtactgctgaagcggcaacccctgagagcggcccaggtacttctgagagcgccactcctgaatccggccctggtagcgagccggcaacctccggctcagaaactcctggttcggaaccagcgaccagcggtaccgctgaagccgcaggttgtggcactgcggaagctgcaaccgaagagggtaccagcacggaaccgagcgagggttctgccccgggtacttccaccgaaccatcggagggctctgcacctggtagcgaacctgcgacgtctggttctgaaacgccgactgcagaagcggctggttgtggcaccgccgaagcagctagcgcctctcgctccgcacatcaccatcaccaccatcatcactaa

SEQ ID NO: 1088 - protein, 486 aa, Artificial Sequence; identical to SEQ ID NO: 376
  Description of Artificial Sequence: Synthetic polypeptide

SEQ ID NO: 1089 - DNA, 2757 bp, Artificial Sequence
  Description of Artificial Sequence: Synthetic polynucleotide
atgaaaaacccagagcaagcagaagaacaagctgaagaacagcgcgaagaaacacgtccgcgtcctcgcccacgtccacgtccgcgtccacgccctcgtcctcgtccgcgccctcgtccgagcgcgtctcgttccgctgggtctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaacggcagaggcagcaggttgtggtacagcagaagcagctccgggtagcgagcctgcaaccagcggttctgagacgccgggcacttccgaatctgcgaccccggagtccggtccaggttcagagccggcgacgagcggttcggaaacgccgggtactgctgaagcggctggttgtggtactgctgaagctgcatcgaccgaaccaagcgaaggttcggcaccgggtactagcgagagcgcaacccctgaaagcggtccgggcagcccggcaggttctccaaccagcaccgaagaaggttcccctgctactgccgaagctgcaggctgcggtactgcggaggcggcgtccccaacttctactgaggaaggtacttctgagtccgctaccccagaaagcggtcctggtacctccactgaaccgtctgaaggctctgcaccaggcacttctgagtctgctactaccgccgaagccgctggttgtggtaccgcagaagctgcatctgagactccaggcacttctgagtccgcaacgcctgaatccggtcctggttctgaaccagctacttccggcagcgaaaccccaggtacctctgagtctgcgactccagagtctggtaccgcggaagcggctggttgtggtactgcagaggcagctggttctccggctggtagcccgaccagcacggaggagggtacgtctgaatctgcaacgccggaatcgggcccaggttcggagcctgcaacgtctggcagcgaaaccccgggtaccacggcggaagcggcaggttgtggcaccgcggaggcagcagctggttctccaacctctaccgaggagggttcaccggcaggtagcccgactagcactgaagaaggtactagcacggagccgagcgagggtagtgctccgggtacgagcgagagcacggcagaagccgctggctgcggtactgctgaagcggcaacccctgagagcggcccaggtacttctgagagcgccactcctgaatccggccctggtagcgagccggcaacctccggctcagaaactcctggttcggaaccagcgaccagcggtaccgctgaagccgcaggttgtggcactgcggaagctgcaaccgaagagggtaccagcacggaaccgagcgagggttctgccccgggtacttccaccgaaccatcggagggctctgcacctggtagcgaacctgcgacgtctggttctgaaacgccgactgcagaagcggctggttgtggcaccgccgaagcagctagcgcctctcgctccgcacatcaccatcaccaccatcatcactaa

SEQ ID NO: 1090 - protein, 918 aa, Artificial Sequence; identical to SEQ ID NO: 377
  Description of Artificial Sequence: Synthetic polypeptide

SEQ ID NO: 1091 - protein, 34 aa, Artificial Sequence
  Description of Artificial Sequence: Synthetic polypeptide
MKIKTGARILALSALTTMMFSASALAAPTTAGAG

SEQ ID NO: 1092 - protein, 9 aa, Artificial Sequence
  Description of Artificial Sequence: Synthetic peptide
RHHHHHHHH

SEQ ID NO: 1093 - protein, 26 aa, Artificial Sequence
  Description of Artificial Sequence: Synthetic peptide
MKIKTGARILALSALTTMMFSASALA

SEQ ID NO: 1094 - protein, 8 aa, Artificial Sequence
  Description of Artificial Sequence: Synthetic peptide
APTTAGAG

SEQ ID NO: 1095 - protein, 12 aa, Artificial Sequence
  Description of Artificial Sequence: Synthetic peptide
RPRPRPRPRPGR

SEQ ID NO: 1096 - protein, 16 aa, Artificial Sequence
  Description of Artificial Sequence: Synthetic peptide
RPRPRPRPRPRPRPGR

SEQ ID NO: 1097 - protein, 12 aa, Artificial Sequence
  Description of Artificial Sequence: Synthetic peptide
KPKPKPKPKPGR

SEQ ID NO: 1098 - protein, 20 aa, Artificial Sequence
  Description of Artificial Sequence: Synthetic peptide
RPRPRPRPRPRPRPRPRPGR

SEQ ID NO: 1099 - protein, 24 aa, Artificial Sequence
  Description of Artificial Sequence: Synthetic peptide
RPRPRPRPRPRPRPRPRPRPRPGR

SEQ ID NO: 1100 - protein, 20 aa, Artificial Sequence
  Description of Artificial Sequence: Synthetic peptide
RPRPKPRPKPRPKPRPKPGR

SEQ ID NO: 1101 - protein, 24 aa, Artificial Sequence
  Description of Artificial Sequence: Synthetic peptide
RPRPKPRPKPRPKPRPKPRPKPGR

SEQ ID NO: 1102 - protein, 10 aa, Artificial Sequence
  Description of Artificial Sequence: Synthetic peptide
  MOD_RES (1)..(1): pyro-Glu
  MOD_RES (6)..(6): D-Lys
  C-term NH2
EHWSYKLRPG

SEQ ID NO: 1103 - protein, 36 aa, Artificial Sequence; identical to SEQ ID NO: 705
  Description of Artificial Sequence: Synthetic polypeptide

SEQ ID NO: 1104 - protein, 36 aa, Artificial Sequence; identical to SEQ ID NO: 706
  Description of Artificial Sequence: Synthetic polypeptide

SEQ ID NO: 1105 - protein, 36 aa, Artificial Sequence; identical to SEQ ID NO: 883
  Description of Artificial Sequence: Synthetic polypeptide

SEQ ID NO: 1106 - protein, 36 aa, Artificial Sequence; identical to SEQ ID NO: 884
  Description of Artificial Sequence: Synthetic polypeptide

SEQ ID NO: 1107 - protein, 42 aa, Artificial Sequence; identical to SEQ ID NO: 57
  Description of Artificial Sequence: Synthetic polypeptide

SEQ ID NO: 1108 - protein, 42 aa, Artificial Sequence; identical to SEQ ID NO: 57
  Description of Artificial Sequence: Synthetic polypeptide

SEQ ID NO: 1109 - protein, 42 aa, Artificial Sequence; identical to SEQ ID NO: 60
  Description of Artificial Sequence: Synthetic polypeptide

SEQ ID NO: 1110 - protein, 42 aa, Artificial Sequence; identical to SEQ ID NO: 61
  Description of Artificial Sequence: Synthetic polypeptide

SEQ ID NO: 1111 - protein, 144 aa, Artificial Sequence; identical to SEQ ID NO: 66
  Description of Artificial Sequence: Synthetic polypeptide

SEQ ID NO: 1112 - protein, 144 aa, Artificial Sequence; identical to SEQ ID NO: 78
  Description of Artificial Sequence: Synthetic polypeptide

SEQ ID NO: 1113 - protein, 288 aa, Artificial Sequence; identical to SEQ ID NO: 85
  Description of Artificial Sequence: Synthetic polypeptide

SEQ ID NO: 1114 - protein, 288 aa, Artificial Sequence; identical to SEQ ID NO: 88
  Description of Artificial Sequence: Synthetic polypeptide

SEQ ID NO: 1115 - protein, 504 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1116 - protein, 576 aa, Artificial Sequence; identical to SEQ ID NO: 91
  Description of Artificial Sequence: Synthetic polypeptide

SEQ ID NO: 1117 - protein, 576 aa, Artificial Sequence; identical to SEQ ID NO: 92
  Description of Artificial Sequence: Synthetic polypeptide

SEQ ID NO: 1118 - protein, 576 aa, Artificial Sequence; identical to SEQ ID NO: 94
  Description of Artificial Sequence: Synthetic polypeptide

SEQ ID NO: 1119 - protein, 540 aa, Artificial Sequence; identical to SEQ ID NO: 90
  Description of Artificial Sequence: Synthetic polypeptide

SEQ ID NO: 1120 - protein, 836 aa, Artificial Sequence; identical to SEQ ID NO: 96
  Description of Artificial Sequence: Synthetic polypeptide

SEQ ID NO: 1121 - protein, 864 aa, Artificial Sequence; identical to SEQ ID NO: 97
  Description of Artificial Sequence: Synthetic polypeptide

SEQ ID NO: 1122 - protein, 875 aa, Artificial Sequence; identical to SEQ ID NO: 98
  Description of Artificial Sequence: Synthetic polypeptide
  MOD_RES (430)..(432): Any amino acid
  MOD_RES (443)..(446): Any amino acid

SEQ ID NO: 1123 - protein, 864 aa, Artificial Sequence; identical to SEQ ID NO: 99
  Description of Artificial Sequence: Synthetic polypeptide

SEQ ID NO: 1124 - protein, 875 aa, Artificial Sequence; identical to SEQ ID NO: 100
  Description of Artificial Sequence: Synthetic polypeptide

SEQ ID NO: 1125 - protein, 1318 aa, Artificial Sequence; identical to SEQ ID NO: 101
  Description of Artificial Sequence: Synthetic polypeptide

SEQ ID NO: 1126 - protein, 924 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1127 - protein, 913 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1128 - protein, 864 aa, Artificial Sequence; identical to SEQ ID NO: 102
  Description of Artificial Sequence: Synthetic polypeptide

SEQ ID NO: 1129 - protein, 4 aa, Artificial Sequence
  Description of Artificial Sequence: Synthetic peptide
GGSG

SEQ ID NO: 1130 - protein, 288 aa, Artificial Sequence
  Description of Artificial Sequence: Synthetic polypeptide
GSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEG

SEQ ID NO: 1131 - protein, 288 aa, Artificial Sequence
  Description of Artificial Sequence: Synthetic polypeptide
GEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEG

SEQ ID NO: 1132 - protein, 288 aa, Artificial Sequence
  Description of Artificial Sequence: Synthetic polypeptide
SSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSES

SEQ ID NO: 1133 - protein, 288 aa, Artificial Sequence
  Description of Artificial Sequence: Synthetic polypeptide
GEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGE

SEQ ID NO: 1134 - protein, 576 aa, Artificial Sequence
  Description of Artificial Sequence: Synthetic polypeptide
GGKPGEGGKPEGGGGKPGGKPEGEGEGKPGGKPEGGGKPGGGEGGKPEGGKPEGEGKPGGGEGKPGGKPEGGGGKPEGEGKPGGGGGKPGGKPEGEGKPGGGEGGKPEGKPGEGGEGKPGGKPEGGGEGKPGGGKPGEGGKPGEGKPGGGEGGKPEGGKPEGEGKPGGGEGKPGGKPGEGGKPEGGGEGKPGGKPGEGGEGKPGGGKPEGEGKPGGGKPGGGEGGKPEGEGKPGGKPEGGGEGKPGGKPEGGGKPEGGGEGKPGGGKPGEGGKPGEGEGKPGGKPEGEGKPGGEGGGKPEGKPGGGEGGKPEGGKPGEGGKPEGGKPGEGGEGKPGGGKPGEGGKPEGGGKPEGEGKPGGGGKPGEGGKPEGGKPEGGGEGKPGGGKPEGEGKPGGGEGKPGGKPEGGGGKPGEGGKPEGGKPGGEGGGKPEGEGKPGGKPGEGGGGKPGGKPEGEGKPGEGGEGKPGGKPEGGGEGKPGGKPEGGGEGKPGGGKPGEGGKPEGGGKPGEGGKPGEGGKPEGEGKPGGGEGKPGGKPGEGGKPEGGGEGKPGGKPGGEGGGKPEGGKPGEGGKPEG

SEQ ID NO: 1135 - protein, 558 aa, Artificial Sequence
  Description of Artificial Sequence: Synthetic polypeptide
GEGKPGGKPGSGGGKPGEGGKPGSGEGKPGGKPGSGGSGKPGGKPGEGGKPEGGSGGKPGGGGKPGGKPGGEGSGKPGGKPEGGGKPEGGSGGKPGGKPEGGSGGKPGGKPGSGEGGKPGGGKPGGEGKPGSGKPGGEGSGKPGGKPEGGSGGKPGGKPEGGSGGKPGGSGKPGGKPGEGGKPEGGSGGKPGGSGKPGGKPEGGGSGKPGGKPGEGGKPGSGEGGKPGGGKPGGEGKPGSGKPGGEGSGKPGGKPGSGGEGKPGGKPEGGSGGKPGGGKPGGEGKPGSGGKPGEGGKPGSGGGKPGGKPGGEGEGKPGGKPGEGGKPGGEGSGKPGGGGKPGGKPGGEGGKPEGSGKPGGGSGKPGGKPEGGGGKPEGSGKPGGGGKPEGSGKPGGGKPEGGSGGKPGGSGKPGGKPGEGGGKPEGSGKPGGGSGKPGGKPEGGGKPEGGSGGKPGGKPEGGSGGKPGGKPGGEGSGKPGGKPGSGEGGKPGGKPGEGSGGKPGGKPEGGSGGKPGGSGKPGGKPEGGGSGKPGGKPGEGGKPGGEGSGKPGGSGKPG

SEQ ID NO: 1136 - protein, 577 aa, Artificial Sequence
  Description of Artificial Sequence: Synthetic polypeptide
GGSGKPGKPGGSGSGKPGSGKPGGGSGKPGSGKPGGGSGKPGSGKPGGGSGKPGSGKPGGGGKPGSGSGKPGGGKPGGSGGKPGGGSGKPGKPGSGGSGKPGSGKPGGGSGGKPGKPGSGGSGGKPGKPGSGGGSGKPGKPGSGGSGGKPGKPGSGGSGGKPGKPGSGGSGKPGSGKPGGGSGKPGSGKPGSGGSGKPGKPGSGGSGKPGSGKPGSGSGKPGSGKPGGGSGKPGSGKPGSGGSGKPGKPGSGGGKPGSGSGKPGGGKPGSGSGKPGGGKPGGSGGKPGGSGGKPGKPGSGGGSGKPGKPGSGGGSGKPGKPGGSGSGKPGSGKPGGGSGKPGSGKPGSGGSGKPGKPGSGGSGGKPGKPGSGGGKPGSGSGKPGGGKPGSGSGKPGGGKPGSGSGKPGGGKPGSGSGKPGGSGKPGSGKPGGGSGGKPGKPGSGGSGKPGSGKPGSGGSGKPGKPGGSGSGKPGSGKPGGGSGKPGSGKPGGGSGKPGSGKPGGGSGKPGSGKPGGGGKPGSGSGKPGGSGGKPGKPGSGGSGGKPGKPGSGGSGKPGSGKPGGGSGGKPGKPGSGG

SEQ ID NO: 1137 - protein, 576 aa, Artificial Sequence
  Description of Artificial Sequence: Synthetic polypeptide
GEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGEGSEGSGEGEGSEGSGEGEGSEGGSEGEGGSEGSEGEGSGEGSEGEGGSEGSEGEGGGEGSEGEGSGEGSEGEGGSEGSEGEGGSEGSEGEGGEGSGEGEGSEGSGEGEGSGEGSEGEGSEGSGEGEGSEGSGEGEGGSEGSEGEGSGEGSEGEGSEGSGEGEGSEGSGEGEGGSEGSEGEGGSEGSEGEGGSEGSEGEGGEGSGEGEGSEGSGEGEGSGEGSEGEGSEGSGEGEGSEGSGEGEGGSEGSEGEGSEGSGEGEGGEGSGEGEGSGEGSEGEGGGEGSEGEGSEGSGEGEGSEGSGEGEGSEGGSEGEGGSEGSEGEGSEGGSEGEGSEGGSEGEGSEGSGEGEGSEGSGEGEGSGEGSEGEGGSEGGEGEGSEGGSEGEGSEGGSEGEGGEGSGEGEGGGEGSEGEGSEGSGEGEGSGEGSE

SEQ ID NO: 1138 - protein, 576 aa, Artificial Sequence; identical to SEQ ID NO: 91
  Description of Artificial Sequence: Synthetic polypeptide

SEQ ID NO: 1139 - protein, 577 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1140 - protein, 540 aa, Artificial Sequence; identical to SEQ ID NO: 90
  Description of Artificial Sequence: Synthetic polypeptide

SEQ ID NO: 1141 - protein, 504 aa, Artificial Sequence; identical to SEQ ID NO: 1115
  Description of Artificial Sequence: Synthetic polypeptide

SEQ ID NO: 1142 - protein, 816 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAP

SEQ ID NO: 1143 - protein, 875 aa, Artificial Sequence; identical to SEQ ID NO: 98
  Description of Artificial Sequence: Synthetic polypeptide
  MOD_RES (430)..(432): Any amino acid
  MOD_RES (443)..(446): Any amino acid

SEQ ID NO: 1144 - protein, 868 aa, Artificial Sequence
  Description of Artificial Sequence: Synthetic polypeptide
GGSPGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1145 - protein, 875 aa, Artificial Sequence; identical to SEQ ID NO: 100
  Description of Artificial Sequence: Synthetic polypeptide

SEQ ID NO: 1146 - protein, 1318 aa, Artificial Sequence; identical to SEQ ID NO: 101
  Description of Artificial Sequence: Synthetic polypeptide

SEQ ID NO: 1147 - protein, 9 aa, Artificial Sequence
  Description of Artificial Sequence: Synthetic peptide
FDKLPRTSG

SEQ ID NO: 1148 - protein, 7 aa, Artificial Sequence
  Description of Artificial Sequence: Synthetic peptide
FKLMVWY

SEQ ID NO: 1149 - protein, 909 aa, Artificial Sequence
  Description of Artificial Sequence: Synthetic polypeptide
APTTAGAGRPRPRPRPRPRPRPRPRPRPRPGRGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGRHHHHHHHH

SEQ ID NO: 1150 - protein, 1068 aa, Artificial Sequence
  Description of Artificial Sequence: Synthetic polypeptide
ANTPVSGNLKVEFYNSNPSDTTNSINPQFKVTNTGSSAIDLSKLTLRYYYTVDGQKDQTFWADHAAIIGSNGSYNGITSNVKGTFVKMSSSTNNADTYLEISFTGGTLEPGAHVQIQGRFAKNDWSNYTQSNDYSFKSASQFVEWDQVTAYLNGVLVWGKEPGGSVVGSGSGSGRGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGKPGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKATHHHHHHHH

SEQ ID NO: 1151 - protein, 939 aa, Artificial Sequence
  Description of Artificial Sequence: Synthetic polypeptide
KNPEQAEEQAEEQREETRPRPRPRPRPRPRPRPRPRPRPSASRSAGSPTAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASRSAHHHHHHHH

SEQ ID NO: 1152 - protein, 965 aa, Artificial Sequence
  Description of Artificial Sequence: Synthetic polypeptide
KNPEQAEEQAEEQREETRPRPRPRPRPRPRPRPRPRPRPSASRSAGSPTAEAAGCGTAEAAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTAEAAGCGTAEAASASRSAHHHHHHHH

SEQ ID NO: 1153 - protein, 485 aa, Artificial Sequence
  Description of Artificial Sequence: Synthetic polypeptide
KNPEQAEEQAEEQREETRPRPRPRPRPRPRPRPRPRPRPSASRSAGSPTAEAAGCGTAEAAGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPTAEAAGCGTAEAAGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPTAEAAGCGTAEAASASRSAHHHHHHHH

SEQ ID NO: 1154 - protein, 341 aa, Artificial Sequence
  Description of Artificial Sequence: Synthetic polypeptide
KNPEQAEEQAEEQREETRPRPRPRPRPRPRPRPRPRPRPSASRSAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASRSAHHHHHHHH

SEQ ID NO: 1155 - protein, 485 aa, Artificial Sequence
  Description of Artificial Sequence: Synthetic polypeptide
KNPEQAEEQAEEQREETRPRPRPRPRPRPRPRPRPRPRPSASRSAGSPTAEAAGCGTAEAAPGSEPATSGSETPGTSESATPESGPGSEPATSGSETPGTAEAAGCGTAEAASTEPSEGSAPGTSESATPESGPGSPAGSPTSTEEGSPATAEAAGCGTAEAASPTSTEEGTSESATPESGPGTSTEPSEGSAPGTSESATTAEAAGCGTAEAASETPGTSESATPESGPGSEPATSGSETPGTSESATPESGTAEAAGCGTAEAAGSPAGSPTSTEEGTSESATPESGPGSEPATSGSETPGTTAEAAGCGTAEAAAGSPTSTEEGSPAGSPTSTEEGTSTEPSEGSAPGTSESTAEAAGCGTAEAATPESGPGTSESATPESGPGSEPATSGSETPGSEPATSGTAEAAGCGTAEAATEEGTSTEPSEGSAPGTSTEPSEGSAPGSEPATSGSETPTAEAAGCGTAEAASASRSAHHHHHHHH

SEQ ID NO: 1156 - protein, 917 aa, Artificial Sequence
  Description of Artificial Sequence: Synthetic polypeptide
KNPEQAEEQAEEQREETRPRPRPRPRPRPRPRPRPRPRPSASRSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPTAEAAGCGTAEAAPGSEPATSGSETPGTSESATPESGPGSEPATSGSETPGTAEAAGCGTAEAASTEPSEGSAPGTSESATPESGPGSPAGSPTSTEEGSPATAEAAGCGTAEAASPTSTEEGTSESATPESGPGTSTEPSEGSAPGTSESATTAEAAGCGTAEAASETPGTSESATPESGPGSEPATSGSETPGTSESATPESGTAEAAGCGTAEAAGSPAGSPTSTEEGTSESATPESGPGSEPATSGSETPGTTAEAAGCGTAEAAAGSPTSTEEGSPAGSPTSTEEGTSTEPSEGSAPGTSESTAEAAGCGTAEAATPESGPGTSESATPESGPGSEPATSGSETPGSEPATSGTAEAAGCGTAEAATEEGTSTEPSEGSAPGTSTEPSEGSAPGSEPATSGSETPTAEAAGCGTAEAASASRSAHHHHHHHH

SEQ ID NO: 1157 - protein, 197 aa, Artificial Sequence
  Description of Artificial Sequence: Synthetic polypeptide
KKQEQEEKKAEEQREETRPRPRPRPRPRPRPRPRPRPRPSASRSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASRSAHHHHHHHH

SEQ ID NO: 1158 - protein, 485 aa, Artificial Sequence
  Description of Artificial Sequence: Synthetic polypeptide
KKQEQEEKKAEEQREETRPRPRPRPRPRPRPRPRPRPRPSASRSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTESASRSAHHHHHHHH

SEQ ID NO: 1159 - protein, 629 aa, Artificial Sequence
  Description of Artificial Sequence: Synthetic polypeptide
KKQEQEEKKAEEQREETRPRPRPRPRPRPRPRPRPRPRPSASRSAGSPTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASRSAHHHHHHHH

SEQ ID NO: 1160 - protein, 197 aa, Artificial Sequence
  Description of Artificial Sequence: Synthetic polypeptide
KKQEQEEKKAEEQREETRPRPRPRPRPRPRPRPRPRPRPSASRSAGSPTEGTSTEPSEGSAPGTSESTAEAAGCGTAEAATPESGPGTSESATPESGPGSEPATSGSETPGSEPATSGTAEAAGCGTAEAATEEGTSTEPSEGSAPGTSTEPSEGSAPGSEPATSGSETPTAEAAGCGTAEAASASRSAHHHHHHHH

SEQ ID NO: 1161 - protein, 485 aa, Artificial Sequence
  Description of Artificial Sequence: Synthetic polypeptide
KNPEQAEEQAEEQREETRPRPRPRPRPRPRPRPRPRPRPSASRSAGSPTPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPTAEAAGCGTAEAASASRSAHHHHHHHH

SEQ ID NO: 1162 - protein, 485 aa, Artificial Sequence
  Description of Artificial Sequence: Synthetic polypeptide
KNPEQAEEQAEEQREETRPRPRPRPRPRPRPRPRPRPRPSASRSAGSPTGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPTAEAAGCGTAEAAGSPAGSPTSTEEGTSESATPESGPGSEPATSGSETPGTSESATPESGPGSPAGSPTSTEEGSPAGSPTSTEEGTSTEPSEGSAPGTSESTAEAAGCGTAEAATPESGPGTSESATPESGPGSEPATSGSETPGSEPATSGSETPGSPAGSPTSTEEGTSTEPSEGSAPGTSTEPSEGSAPGSEPATSGSETPTAEAAGCGTAEAASASRSAHHHHHHHH

SEQ ID NO: 1163 - protein, 485 aa, Artificial Sequence
  Description of Artificial Sequence: Synthetic polypeptide
KNPEQAEEQAEEQREETRPRPRPRPRPRPRPRPRPRPRPSASRSAGSPTPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESTAEAAGCGTAEAATPESGPGTSESATPESGPGSEPATSGSETPGSEPATSGTAEAAGCGTAEAATEEGTSTEPSEGSAPGTSTEPSEGSAPGSEPATSGSETPTAEAAGCGTAEAASASRSAHHHHHHHH

SEQ ID NO: 1164 - protein, 917 aa, Artificial Sequence
  Description of Artificial Sequence: Synthetic polypeptide
KKQEQEEKKAEEQREETRPRPRPRPRPRPRPRPRPRPRPSASRSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASRSAHHHHHHHH

SEQ ID NO: 1165 - protein, 197 aa, Artificial Sequence
  Description of Artificial Sequence: Synthetic polypeptide
KKQEQEEKKAEEQREETRPRPRPRPRPRPRPRPRPRPRPSASRSAGSPGSTSSTAESPGPGSTSSTAESPGPGCTSESPSGTAPGSTSSTAESPGPGSTSSTAESPGPGTSTPESGSASPGSTSCSPSGEAPGTSPSGESSTAPGSTSESPSGTAPGSTSESPSGTAPETSPSGESCTAPGSTSASRSAHHHHHHHH

SEQ ID NO: 1166 - protein, 197 aa, Artificial Sequence
  Description of Artificial Sequence: Synthetic polypeptide
KKQEQEEKKAEEQREETRPRPRPRPRPRPRPRPRPRPRPSASRSAGSPGTPGSGTASSSPGSSTPSGATGSPGCAGSGTASSSPGSSTPSGATGSPGTPGSGTASSSPGSSTPSGATGSPGSSTCSGATGSPGSSPSASTGTGPGSSPSASTGTGPGASPGTSSTGSPGTPGSGTACSSPGSSSASRSAHHHHHHHH

SEQ ID NO: 1167 - protein, 917 aa, Artificial Sequence
  Description of Artificial Sequence: Synthetic polypeptide
KKQEQEEKKAEEQREETRPRPRPRPRPRPRPRPRPRPRPSASRSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASKSAHHHHHHHH

SEQ ID NO: 1168 - protein, 341 aa, Artificial Sequence
  Description of Artificial Sequence: Synthetic polypeptide
KNPEQAEEQAEEQREETRPRPRPRPRPRPRPRPRPRPRPSASRSAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTACSEGSAPSASRSAHHHHHHHH

SEQ ID NO: 1169 - protein, 341 aa, Artificial Sequence
  Description of Artificial Sequence: Synthetic polypeptide
KNPEQAEEQAEEQREETRPRPRPRPRPRPRPRPRPRPRPSASRSAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSCASASRSAHHHHHHHH

SEQ ID NO: 1170 - protein, 917 aa, Artificial Sequence
  Description of Artificial Sequence: Synthetic polypeptide
KKQEQEEKKAEEQREETRPRPRPRPRPRPRPRPRPRPRPSASRSAGSPGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGSTSSTAESPGPGTSPSGESSTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGSTSSTAESPGPGTSPSGESSTAPGSTSESPSGTAPGSTSESPSGTAPGTSTPESGSASPGSTSESPSGTAPGSTSESPSGTAPGTSTPESGSASPGSTSESPSGTAPGSTSESPSGTAPGSTSESPSGTAPGSTSSTAESPGPGTSPSGESSTAPGTSSASRSAHHHHHHHH

SEQ ID NO: 1171 - protein, 917 aa, Artificial Sequence
  Description of Artificial Sequence: Synthetic polypeptide
KKQEQEEKKAEEQREETRPRPRPRPRPRPRPRPRPRPRPSASRSAGSPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASSASRSAHHHHHHHH

SEQ ID NO: 1172 - protein, 197 aa, Artificial Sequence
  Description of Artificial Sequence: Synthetic polypeptide
KKQEQEEKKAEEQREETRPRPRPRPRPRPRPRPRPRPRPSASRSAGSPGSCAGSPTSTEEGTSESACPESGPGTSTEPSEGSCPGSPAGSPTSTEEGTCTEPSEGSAPGTSTEPCSGSAPGTSESATPESCPGSEPATSGSETPGSCPATSGSETPGSPAGSCTSTEEGTSESATPESCPGTESASRSAHHHHHHHH

SEQ ID NO: 1173 - protein, 341 aa, Artificial Sequence
  Description of Artificial Sequence: Synthetic polypeptide
KNPEQAEEQAEEQREETRPRPRPRPRPRPRPRPRPRPRPSASRSAGSPTGCGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSCTPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSCGSAPSASRSAHHHHHHHH

SEQ ID NO: 1174 - protein, 341 aa, Artificial Sequence
  Description of Artificial Sequence: Synthetic polypeptide
KNPEQAEEQAEEQREETRPRPRPRPRPRPRPRPRPRPRPSASRSAGSPTGCGSEPATSGSETPGTSESATPESGPGSEPATSGSCTPGTSESATPESGPGTSTEPSEGSAPGSPAGSPCSTEEGTSESATPESGPGSEPATSGSETPGTSESCTPESGPGSPAGSPTSTEEGSPAGSPTSTEEGTSCTPSEGSAPGTSESATPESGPGTSESATPESGPGCSESATPESGPGSEPATSGSETPGSEPATSGSETCGSPAGSPTSTEEGTSTEPSEGSAPGTSTEPSEGCAPGSEPATSGSETPGTSESATPESGPGTSTEPSCGSAPSASRSAHHHHHHHH

SEQ ID NO: 1175 - protein, 10 aa, Artificial Sequence
  Description of Artificial Sequence: Synthetic peptide
  MOD_RES (10)..(10): Any amino acid
GGGSLPETGX

SEQ ID NO: 1176 - protein, 11 aa, Artificial Sequence
  Description of Artificial Sequence: Synthetic peptide
GGGSLPETGGG

SEQ ID NO: 1177 - protein, 11 aa, Artificial Sequence
  Description of Artificial Sequence: Synthetic peptide
ASTGETGETGE

SEQ ID NO: 1178 - protein, 432 aa, Artificial Sequence; identical to SEQ ID NO: 364
  Description of Artificial Sequence: Synthetic polypeptide
  MOD_RES (12)..(12): Cys modified with folate-gamma-Mal
  MOD_RES (217)..(217): Cys modified with folate-gamma-Mal
  MOD_RES (422)..(422): Cys modified with folate-gamma-Mal

SEQ ID NO: 1179 - protein, 432 aa, Artificial Sequence; identical to SEQ ID NO: 364
  Description of Artificial Sequence: Synthetic polypeptide
  MOD_RES (12)..(12): Cys modified with a MC-Val-Cit-PAB-MMAE side chain
  MOD_RES (217)..(217): Cys modified with a MC-Val-Cit-PAB-MMAE side chain
  MOD_RES (422)..(422): Cys modified with a MC-Val-Cit-PAB-MMAE side chain

The invention claimed is:

1. A composition comprising a homogeneous population of polypeptides comprising an extended recombinant polypeptide (XTEN), wherein at least 90% of individual polypeptide molecules in said population have an identical sequence length, wherein the XTEN is characterized in that:
   (a) the XTEN is 36 to 3000 L-amino acid residues in length;
   (b) the sum of glycine (G), alanine (A), serine (S), threonine (T), glutamate (E) and proline (P) residues constitutes more than 90% of the total amino acid residues of the XTEN; and
   (c) the XTEN sequence comprises one or more sequence motifs selected from SEQ ID NOs: 26-55 and one or more sequence motifs selected from SEQ ID NOs: 399-407;
   wherein the polypeptides of the population have a configuration of formula II:

(HS)-(CS1)-(XTEN)-(CS2)-(AT1)    II wherein
   (i) HS is a sequence having at least 90% sequence identity to a sequence selected from SEQ ID NOs: 517-526;
   (ii) AT1 is a first affinity tag having an amino acid sequence exhibiting binding affinity for a chromatography substrate selected from the group consisting of hydrophobic interaction chromatography (HIC) substrate, cation exchange substrate, anion exchange substrate, immobilized metal ion affinity chromatography (IMAC) substrate, and immobilized antibody substrate;
   (iii) CS1 is a first amino acid sequence capable of being cleaved by trypsin;
   (iv) CS2 is a second amino acid sequence capable of being cleaved by trypsin; and
   (v) XTEN is the extended recombinant polypeptide.

2. The composition of claim 1, wherein the XTEN sequence has at least 90% sequence identity to a sequence selected from SEQ ID NOs: 193-205, 219-258, 267-279, 293-332, 341-350, 361, 362, 364-369, 373, 374, 376, 377, 379-385, and 387-391.

3. The composition of claim 1, wherein the XTEN sequence comprises at least 1 to 10 cysteine amino acids.

4. The composition of claim 1, wherein the AT1 is selected from SEQ ID NO: 18, SEQ ID NO: 20, and SEQ ID NO: 433-447.

5. The composition of claim 4, wherein the first chromatography substrate is IMAC or cation exchange substrate, and the AT1 comprises the sequence HHHHHH (SEQ ID NO: 18) or HHHHHHHH (SEQ ID NO: 20).

6. The composition of claim 5, wherein the CS1 and the CS2 amino acid sequences independently comprise the sequence RX or KX, wherein X is any L-amino acid other than proline.

7. The composition of claim 5, wherein the CS1 and the CS2 amino acid sequences independently are selected from SEQ ID NO: 467, SEQ ID NO: 468, SEQ ID NO: 469, SEQ ID NO: 470, SEQ ID NO: 471, and SEQ ID NO: 472.

8. The composition of claim 7, wherein the CS1 and the CS2 amino acid sequences independently are SASRSA (SEQ ID NO: 467) or SASKSA (SEQ ID NO: 468).

9. The composition of claim 6, wherein the polypeptides of the population further comprise a second affinity tag selected from SEQ ID NO: 18, SEQ ID NO: 20, and SEQ ID NOs: 443-447, and wherein the second affinity tag exhibits binding affinity for a chromatography substrate selected from the group consisting of hydrophobic interaction chromatography (HIC) substrate, cation exchange substrate, anion exchange substrate, immobilized metal ion affinity chromatography (IMAC) substrate, and immobilized antibody substrate.

10. A polynucleotide encoding the composition of claim 6.

11. A host cell comprising a vector comprising the polynucleotide of claim 10.

12. A method of producing a composition comprising a homogeneous population of polypeptides, the method comprising:
   (a) providing the host cell of claim 11;
   (b) culturing the host cell under conditions causing or permitting the population of polypeptides to be expressed in the host cell, thereby producing the population of polypeptides;
   (c) adsorbing the expressed population of polypeptides onto a chromatography substrate under conditions effective to capture the AT1;
   (d) treating said composition with trypsin under conditions effective to cleave the CS1 and CS2 amino acid sequences; and
   (e) recovering the XTEN.

13. The method of claim 12, wherein at least 90% of the recovered XTEN have an identical sequence length.

14. The method of claim 12, wherein the chromatography substrate is selected from the group consisting of hydrophobic interaction chromatography (HIC) substrate, cation exchange substrate, anion exchange substrate, immobilized metal ion affinity chromatography (IMAC) substrate, and immobilized antibody substrate.

15. The method of claim 14, wherein the chromatography substrate is immobilized metal ion affinity chromatography (IMAC) substrate.

16. The method of claim 12 wherein the host cell is a prokaryotic cell.

17. The method of claim 12, further comprising attaching a first cross-linker to the recovered XTEN, wherein the first cross-linker is selected from an N-maleimide, an iodoacetyl reagent, a pyridyl disulfide reagent, a vinyl sulfone reagent, 3-propargyloxypropanoic acid, (oxyethyl)$_n$-acetylene where n is 1-10, dibenzylcyclooctyne (DBCO), cyclooctyne (COT), 3-azide-propionic acid, 6-azide-hexanoic acid, and (oxyethyl)n-azide, where n is 1-10.

18. The method of claim 17, wherein the first cross-linker is conjugated to the XTEN at a location selected from:
   (a) an alpha-amino group of an N-terminal amino acid residue of the XTEN; and
   (b) a thiol group of a cysteine residue of the XTEN.

19. The method of claim 17, wherein the first cross-linker is N-maleimide.

20. The method of claim 17, further comprising conjugating a first payload to the first cross-linker through a single atom residue of the first payload, wherein the residue is selected from the group consisting of carbon, nitrogen, oxygen and sulfur.

21. The method of claim 20, wherein the first payload is selected from doxorubicin, paclitaxel, monomethyl auristatin E, monomethyl auristatin F, maytansine, maytansinoid DM1, maytansinoid DM4, calicheamicin, desacetylvinblastine monohydrazide, camptothecin, mitomycin C, epothilone, hTNF, IL-12, bortezomib, ranpirnase, Pseudomonas exotoxin, SN-38, rachelmycin, m-TOR inhibitor, rapamycin, tubulysin B, tubulysin M, and duocarmycin.

22. The method of claim 17, further comprising conjugating a payload to the first cross-linker, wherein the payload is selected from doxorubicin, paclitaxel, monomethyl auristatin E, monomethyl auristatin F, maytansine, maytansinoid DM1, maytansinoid DM4, calicheamicin, desacetylvinblastine monohydrazide, camptothecin, mitomycin C, epothilone, hTNF, IL-12, bortezomib, ranpirnase, Pseudomonas exotoxin, SN-38, rachelmycin, m-TOR inhibitor, rapamycin, tubulysin B, tubulysin M, and duocarmycin.

23. The method of claim 22, further comprising conjugating a targeting moiety to the N-terminus of the XTEN, wherein the targeting moiety is a peptide, protein, antibody-like scaffold, antibody, or antibody fragment, and wherein the first cross-linker is conjugated to a thiol group of a cysteine residue of the XTEN.

24. The method of claim 23, wherein the targeting moiety is an antibody or antibody fragment.

* * * * *